United States Patent 12,746,261 (PROBIOTIC BACILLUS COMPOSITIONS AND METHODS OF USE) - sequence listing, part 6

SEQ ID NO: 8 - DNA, 1000000 bp, Bacillus amyloliquefaciens
cctatgagcaatgcgacaacgcccactaggatgccaacccataaagtcattttatttcctccttcatgttgtctagtttaaagtgtactaaaccaaaggctattatacaacatttacatctctttttcctcgtttttagacaaaatttctttccctgaccggatttaaccacccgtagcgccgtgtcttgaaatccattgcaagaaaacaggggctgattttacgcagaatctcaaagaaaatcgtttccgcctcataatctcccgaagccgcaatctcaattaaactgtctttcatcatgaaggtggcgcggcccttttctccgggcagtgtaagccggtaaatggaatccaaacggctgtaactcattcggtttaaatgcagctggagccgctgatgcatatgtatcaccggaatcggttccgttatatattgaacttgcttttctgtcatttgatattcctggggtgtcagatctgtccaatgatagtctcgaaacaactcaaacatagccgtttcccgcccgaagtagtggttcgcaaactcatcctttatcaggtgcgtatagtaatgacgttccatttcctcatccccttttacagcgcttcgttattgctttctattatacaaaaggagaaaagaaagaattgtctattactgttacgccgccccttctatttttgtcgcataaacaggaaaaagaggatgatttgactcatcctcttttgtctcgttatttgtttagaagttttttcacgcggtcaactacgttttctgcagtaaacccgtattctttcataattgtttctcccggagctgaagcaccgaaacggtcaattgcgagaacgtctccttcaagaccggtaaatttgccccatccgaagcttgaacccatttcgatcgcaagacgtttcgtcacattcggaggaagcacgctgtttttgtactcagccgattgtttttcaaagcggtcccagctcggcatgctgactacagatacgtgaatgttttcttcagccagtttcgcttgagcttcgatcgcaagtccgacttcagagcctgtcgctaaaagaagggcgtccggtgaatcggtttttgctttggaaacggtataagcccctttttccacgcccgcatacgcttcttcagcctgctgatcaatcgtcggcaggttttggcgtgtcaatacaagagctgtcggatgatcttggctttgaacggcaaccttccatgcagctgcggtttcatttccgtcagcaggtctgatcacagaaaggttaggaagtgcgcgtaaagaagcaagctgctcaatcggttcgtgagtcggcccgtcttctcctacggcaatactgtcatgcgtgaatacataagtgacagggagtcccatcaatgatgccagacgaatggcaggtcttaaataatcagagaatacaaagaatgtgccgccgaatacgcggaggccgccgtgaagcgccattccgtttaatgcagcgcccatcgcaaattcacggacaccgaaccagaagtttttcccggcgtagtctttggccgtgaagtctcctccatttttgattgtcgttttatttgaacccgcaaggtcagcagatcccccgacaaagaaaggaattttcttggcgatcccgttcagtacctcacctgaagatgcgcgggaagcaaggctgctgcctttttcataaacgggaacttcctgatcccagtctttaggaagctcgcctttcatgccgagtgacagctgttcagcaagctcaggatatttttctttataagccgcgaacagttcattccattcctgttcttttttcgagccggcttcttttacagcttgattgaaatgcccgtatacttcttccggaacataaaaatcttcttcaaacgtccaagcatacgcttcttttgtcagcttgctctcttctagtcctaacggagcgccgtgaacgccggatgtgcccgcacggtttggagaaccgaaaccgatcgtggttttcacttcaatcaaagtcggttttttatcattctggcgcgctttttcaattgcagccgtcaattcagcgatgttgtttccgtcctcaacataaagaacttcccagttcattgcttcaaaacgctgctttacattttcagagaaagatcggtctaaatcgccgtctaaggaaatgtcattagaatcgtataatacgatcaggcggcctaattcaagatggcctgcaagagaagcggcttcggaagaaatgccttccattaaatcgccgtctccgcaaatactgtatgtataatgatcaactacgttgaatgaatcacggttatatgtctcagccagatggcgttctgcaattgccattcccactgccattgcaatcccctgtccaagcggcccggtcgttgcgtctactccggctgtatgcccgaactccggatgtcccggtgttttgcttccccattgacggaactgtttcaagtcttcaatgctgaggtcatatccgcttaaatgcagcatgctgtataaaagcattgaaccgtggcctgctgataaaacaaagcggtcgcggttaaaccagcccggattctgcggatttacattcataaatttcgtccacagcgtgtatgccatcggagcggctcccatcggcatgcccggatgtccggaattcgctttttcaattgcgtctatagatagtgtacgaatggtggcaactgatttcttttcaattgtatccattataatccccttccttattgttgtaccttttcatcataaagcgatgctgactttttctcaactctttcagcttaaatttgagataaacttgttgaaaattgtcgtaaagcacatcctgatattagtatatacgaaaaaagaatacgtattgccgtattctttctgtttagtgaagattatttttctgttgttctctttttaatttttcaggggtgacatcgttgccttccggatcaatcacttttacgctctttaacgtatttttcattgaggagcggaatcctttcaaatactcctggcgaagcttttgctgttcagctttttcctcatccgttattgtgtttgatttagctttttgagccaattcgttaattcttgcgattttttctttagaaatcataataagctcctttggtgcgtgttgattatatactactaaaacgcagtcttttttacaactgatgcgcgtcagctgccttctgtgtctgcggtatattcctgaaaccgccggtgaaccgtggctttggacacgtcatagccgaatcctcttaaggtcgctgcgatttctgcaaaggtaagcttgttggctctcagcctgataatttccgaaaccggaacctcttttttttcttttccgctgttttcatgtctgtttttcagattccgttcaggcttgtagccgtttttcacggctcttttcattccccgccggattttcatattgtgaattttcctctgatattcctcaacaatactgacgatttcaagtaccatcgaatcagcttcggaaagctccagttcacctttatgagccgtcgtatatattttaacgttctccctgtaaatacaatgcaaaagcgcaatcttggcgtttcctcttcccaatctcgtttcgtcctgcaccaatatcgcgtcaatatgtgattttttaatttcatcaagcatttcaaatactccgtcgcggtccatttcgtaaccgctggctttctcagaaatgactttcacgacttccatgccgtttgcagcagcgatctcactgagctcctcttcctgtctttttaatgacgtttgctgctgttctttgtttgtgcttacgcgggcataaatgagcgccttcatttctctctttcctctctaattgacaatggccagctgatatacggccggatgcttcttcttaaccggtagaataagttcgtctccgggctttatatcagcagtctggagatgattattctccgtcacccactcaatgaaatcttctttattaatgtgtttcttttctgctacatgatctgcaagtgaccagagtgtatcgccgtcctgaacctttattttaacatattggctgagggactgatcatttcccgcacatgaaacaagtaaaatagcggcacttaaaatcgcagtaaacagcccgacaaatatgatagattctttcgccatgtaaacaacctccgataagaatgtttgttcgctttttatatctttcagtatatacgaacaaatgtttctgtcaatcgtttttttcgaacctatgtttgtactgtcaggaaaatcatgctataatctacttaaaatcgacgttttgaggtgcgaaatatgacgaagctatcaaaaaggcagcttgatatcctgcgttttattaaagaagaggtaaaaacgaaaggatatccgccttctgtaagagagataggagaagcagtaggactggcttccagttcaaccgtgcacggccatttggcgcggctggagacaaaaggcctgatcagacgggaccctacgaaaccgagggcgattgaggtattggatgaagaagaagtccatattccgaaaagccaggtcgtaaacgttccggtcatcgggaaagtgacggcgggtattccgattacggctgttgaaaatatcgacgagtattttccgcttcctgaccggatggttcctccgggcgaacatgtctttatgttagaaatcatgggagaaagtatgattgacgccggcatttttgacaaagattacgtcattgtcaaacagcagaacacggccaataacggagaaatcgtcgtagctatgaccgaagatgatgaagcgacggtcaagcgcttctataaagaagacaattatgtgcggctgcagccggaaaatccgacgatggagccgattatcctgcaaaacgtaagcattttggggaaagtgatcggcgtattcagagccgtccattaattctattaaacttcatttatcgtaaaaaacccctctgtaaggggtttttttgcataaaaaaagcagattcgccctggcttaagaaacgaacctgctaaggaggaaaaacttacattcttattatccgacatcgcacttttgaagtcaactaataatgtttccctcgagaaacttttcattcatttttcaactttttatatatttgtgcgtgatgaatttgcttttttatcttttctttgggcgggcacgtcaaaaaatttatatatgaatatttagtacatagtgcaataagttaaatataaatataaaaaaacccgctgcctttagcgagtatctattttcaatcaaaatgataatattctacaccgtagaaccctttaatatagacgggaccacagacgtttgaagaactttcaaccagaatcctgtatttgtgatacggatcaattgattttttatcttgggcactgaggtttaaccagctgccgctgtagtttttagaacttaatgtataaaaatttccgttcagcgccatccgctggagtttcatgcttaaaccgcacgaagagttgttcattatggtgaacttatagcctaaaaagtaatcgtcggcagctacagcacccggattttcaatatgaaactcttttgcgtttccctccaaagtgaagcttgtttttgatccgaattcagtggtagccgctttagctgagtgtattccgctaaaacataataaaaaaacagcaatacatatccagtattttttcatttgcatccccctttttacatattttaacttgtgaatcctgtgatgtctattcacattttactttataaccactatatacctgtttaaaaatttgcggattgcttacaatgaagactaaacgaaataacgaaggtggttcaaatgaaacacgtaattgctttcgcttctaaaacggcgctcacacttgctttactgtacattgttctggatcttatgtaccaagtaacctttttaaacgttctgtttattacagtgatcttaagtttaatcacttattttgcgggtgattgcatgattctgccgagaacaagcaatttcacagccgttgcagctgatttcggaatttcattcattatattatggatattcctgatgaacattggcgggtttaatgtctctcctgccgcggcagcggttatctctgcactttgcatttctgtttttgaggcattttttcaccggtatttgcagcaatatgtacttcccgaagattataaggacacaacagagacggatagcacgctatggagctatcaaaccgaggcgtctgaagaattagtgccggaaaaagaccctcaggaaaaaacataaaaaggaggcaatcgcctcctcctctttttacttttgcttctgatcgtcaagcggcagctgcagcagtgagtctgtgcctgtcgctttcggcgtttttccgtcccatttttcaatccatttatatttgatcatttcatcggacattgatttcttaatgatttcgttatagtcagcgatcccttccgcttcaatttttttctttttcgcttcggcttcggctattttaatttcagtttgtgtccgttcaagttcctgtgaagacttcacccttgcatcgatggcttcctgtgtggctttatccggcttcggtacgccaagcgtcagatcatcaattaaaaatccgagactcttcatatcatcagcaaatctcttttgaacatcggccgcggcttcagcagatttttgcccgtatgtgtcaataaccgagtatttgctgattgattttcgcgccgcatcccacagccttgtttttaaatatgtattttcaatcgtttcgacgtctaccgccccgaatttgttaaacagatcgactactttatcaggctgcacgacatagttgtaagcgatatccatttctatatttttaccatcagaggttgccacttttatattttcattattcactgtctgcatacgcaccggatattccgttactttattaaataatccgactaagtgccagccttggtccaatgtgtcggattttaccccgccattcggtgagtatacaaccccgacataaccgttcggtattttttcaatgaatagtgacgctgtgacgcccgcaattaaaagggctgcacctataatcacaccgccgagaattttttttgtgtttccgcgcttattttcgctcatgctgatcttcttcctcccatgacttttttaattttttggctccgcttcccacttgtttaaagattggactaagcatcagccataaaccgaatccgatgatgacaagaagaatgatagacccgatcatcactttcatttgcccacctcttttctttcatcctgtcaattatgtatacgatcttaagaacttaaagtttcataaatttcaaaagaaaaagccccgccgacaaaataagcgtgcttattaataattgtcactgataaaatcagaaatcgtttttgtaaattggtaaaaggtcccgttttgtgcggatgctctgcttttcagcgtaaaggtgtcaaatagtgattttctgaagccggtgctcatttcgatttgaatactcaatccggatgaagattgattggcaaggttgttcggactgacgcctgcgtatttatcatttgtgccaagaagaacggcaggatacccgtgccgtttcagcacatcggtcaagagttcggcccgttctctgtctgtaccgccgatttttatctttttatcatcactgccgtaaccgtgcaatgaaatgacattagagtgccctttcaccatttgcacggccttggtttcatcgaaatgcgaacttgtcaaatgcagagctgcattaccggctgattttaacccttcaaataaatataaactccggttttcggcaatttctctggctaactcactggtccccggctctatgcctccgccgtgtatagctaatatgaggacagaagggtcatgctcccgcgttgaaatggaaaaatcggaaggatcttcattcagctttaattcctcgaaactgccgtaaagatctgaagcggcatcagcccgaaagaacggcagaagcaaaaacggtaaaattaaaattgaaattccttttttggttattgatggcatttgtatgtttatgttacaatacaaatgcttcagcctttgaagcgaacggcagaacagggtgactttggacggtttcttctgctctgcctctttgccggctgctttacggtctactcttctaaccctttttgccataacatcatcctttcttttgtttacacttttgtcacaatattatatacgttggacaaaacctccgttcatcttgaagaataaaaacatcaaaacaacctctatcctttagcctaaaaaagtctttctgttcaaagagacggaaagcttaaatgataaaaatgaaacccgtctccttagttttgtttgatttcccaattcaagaatccccgaaaaaatttgaatgtaactgctgtctccataaaaaaaagactgctgttaagcagtctttttttcgttttatttcgtgcctgttgatcccagtccgccgcggtcattgttcccgagcttgtctacttcgatcagctccacttcaggcattttcttcatgattctgaattggcatatccgctcccccttggaaatgtcggtatcccgaagcgcgaatgcaggaaaaaaccagaagtcattgtcgcctttataagattcatcaatgactcccattgaatttgtctgaatgatcccgaaatgcttatatgtacttgaacgcggaacgacatgggcctcgtatccttccggcagttccatcgcaactccaagcgggataagtttgaattcgccttttttgattgttatatgttcagctgcccgcagatcaatccaatcgccctgttcaattttactgattctcgtttgcgtatcatctgaatatttaattttgatttgtaaagtcatgttcgctgctccttttgcttccctatttcagtcgtattgatgaccaatccgtgccccattataccatttaactgataagaatgctgattttggtgtatatgcagccgaagaggaagcacggcgaagacaatgagaataaacctaaaatgaggacccctcctatcagtttttccctccattttcacatgacagcttcaattacaataatgcaaagctatatgtccgttcctttcaacagagcttttttaaaatttcgcctcggtttcaaaaggaatttcgttctgaataaagaatttgaagaataagcgcttaaagggcgcgcgattcttttctgtcccctgcctcaggcgcttatatcaaaagaaagaggtgtctttagaatggttcaatttaaaaactttcctgatccgtctttaaacgccccattgcagtctcgccctgcacagccctctgaattggagcatctcaaagcaaggatgcagaattttattaagcattccgcaacggatgataatcttgagatcgcagatgcccgggtgacggcggaaggaatggtcacctcacttttaaaagaacggcttgatacagaatacgaaatgcttatgaataaaatcacccgggaagtgaatgtggaggattacggagcggtccctgacggccgggacaatacagaagcctttcggaatgcgatcgggaacggccgggtcaaagtaaatgttcccgcaggagaatttttggttcaagggataaaactcccctcatggactactatttccggtgagggacaagggattaccgtgcttaagcttcatgaggacactcccgcatacgaatgggtcattactaacgatgattacgaaaatggaaaccgtaatatttttgtccagaacatgactttagactggaatcctgaccgtcaatgcggagtcaggaaccccggaggacagtgttccagctgtttaacgtttgctaatgtgcaatacggctggattaagaatgttgaaacggttaacgcgggtctgcatggtatagatattacatctccgacttacgatcatttgcctgaaacagaatggacgaaagacggctgccgttatatatggattgataactgtgtggcatacggcgccggagacgacggcattaccacccattacagcgaatatattttcatttccaactgccattccggaaacccccgcggcacagagcatgctgagggcagcgcaaactcgaacggcattgaaattgacgacggctctaaacatgtgtggcttttaaataactatacgagcggaaatatccgcgggattgaggtaaaggcgcacagcctgtggccggcttctcaaaatgttcatattatcggtcatgtttcgtatcgtgatgtacgttcatttgatattcgtcatatcggccatcatcaggcctcagaccccgaaagcacgacggcttatgatgttactttaaccgattgcaccgcgattgaaccggtattcaatgccctctatgacggtgtaaccccgagggcgctggtcatctctgcctataaaaacgttaatgtaaacggattcacagctattggtgatccctcatacgactatggcgggaatccagtcgtggctcttcaataccgcagtcaaaatattacgatcaacggcattaaaatacgcggctttacacaagccggggttgacatcaatatatccggcggatctaataaaaccgattatgttaaaattttaaattttgatatatacaagtcttctcctaaaggcatcacaatcggcggaggccaatataacgtaaatattatgaacggtacgatgatcggagacggcggttccgtcggaattacgtcccctaacagtcaggctgtcattctcggggtgcaagcggaaggttacagcgctgccgcatctataaaaggacagacttatgagcagatccccgtcaatttaaagggaggcgcacagctcgcgaccagctccggttttgcattcaacccgacaagcgccgttattgcgggaacaggcgatattacggccagaggtgacagaaatgcgatcatcagctcttccggaggttcaagttccgaaggttcaagggcatttatcgccgcttcaaacaatgtccatattacgggcggcaaagtctccagaacgattctgtcatcagaaagcattacattggaagaaccatacacggttgccggagggcatcagtccatcaaatggaaactggattcagcgggcggccacggtacgttcgccggagctgtcacctcttccctgtcagggtacggagaatattttgaaagtgtaaccggccagaagattcccgccgggacgatcgtcacagtgaaaggcgaaaaaattgaaccggctcacgtcggtgattatatgctcggcgtcatttcagaaacagccgcttttatctcaggagccgcaagcttcggatggcaaagccgctttttgacaaatgagttcggcggtttcatatacgaaaatgtgactgacgaagaaacaggagaaacagtacgcgtaccgaaacaaaacccggactgcagtccggctcttgaagctgactatgaagcacgcgcggccagagacgaatggcatattgtcggactcaacggccggcattacgtacgagtcgacagtacggtcagcccgggagattatatcacggctcataacggaatcgggactaaagccgcggaaggctggaaggtattgaaactgacggccttatacagcgctgaaaaagggtacggcattgcaattgcggttatcaaataggatctcaatatcaggatcatcttctctcttttctatcgggcgggtataatcctgttttttataccgaatgagatgcctctttttcagcataccgtttcatttgtccaagccatccatgctttctgtcatagaatactaccgtcagatgaaaaaaggaggaatatgagtatgagtatggacatgggtatggacatgggtatggatatgaacggacattatgatcaccagccaaagcagcctaaacaaaagaagaaaaagaagaaacaagataaaaagcatcttgattatgattacatcgttgtttataaaagaaaatgcaaaaaatgctgctgacttgacatatcaatactttttacacccggtaaatcccgggtgtttttcttattatgacgtttctccgggctattttcacccaaaatccggtcatcctatcacaatacataaaaagactctattattttcttcccttttcgcctgattaaaagtatttcatttacagaaaacaacataaatagaatgacatgacttttgagaaaatctgctctttgcttggtcaatttttctgcgataccatgaatttgcaacaattttaaaaaatttcctcaggaggtcatagacatgaaaatcgccagaacaatagtcggatcatgcttagctttatctctaacaattcctttcacagccagtgcctcagcagccagtcagtctgaacacccgaatgcgcctcacgtttcacccgttgcaaatccgttagaaagtaaattatcccaaacagcaggccaaaacgtaaaagcagcaggtgttgatgccgggctgaacgtaaacgtagatgttctcggaatcgcagatcgcatagctgaagcagttaagtcagatcaaaaccgaaccggctgggtaaaaaatgtcatggaaacaacattttacgcatcaggacagaagtacaacgtcatggtgttcaatttaaatcaagaatatgaagaccgctttaacggcgttcaattttacggatcagccgtttatgacggcattacttacggaatctgggtcttcgaagacggttcctttaataacaaaggagacgggggctggatcaattgggcattcagaggatggttcgatcgtgataatcagcatattgaattccacagaccttaattcagagaaaacttgcggcagcgcccgcaagtttttattttgataacgggatactgtacatttttcaccgttataacgactatacttgaagtgcgggctccgatcgcagccccggtaaagtctttcaaagtgagggtatgccatgtcaaagtctttaaaaatagtgttgtggagcatattggttttcattatcttgttagtgatgatcggaatcgtttcttacaatcaaactccgtctgcagaaagcgcagcaaaaagaatgctttacagcgtctaatcaattttaagccttcatcggctttttttatttaccgcagaacacttgaagttcttctgttagatcgttacgttcccattcggaatggagtatacgcgtatatcaccaggcagtccgttttgatacatggttccgattatgcctttcgcatcttttttctctattcctcatcacatccacttttttcatgctgctgctcttgaaaccaaccaatcatttcttcagcctgttccgttgaatcaaaaggttccaatcctaatagcgtgttacattttcatttttaaaaaaacaagccaactgcgcaccctcttcgcaacttctcaatgtatgagcctatccgtttctattacaggaagcagtacgattcctccttttactcattttaacggatggccatgtaaaggaaatatagactaagaaaccttttttcaaaaagtaaactagcatccctatcaaacttttcatttcggcatagtatgtattaatcctctttaggaggtgagattatatgggattctcaggtggttatggtagctcctttgcgttaatcgtggtgctattcattttattaatcatcgttggggcttctttcctcggcggttattaagaatcctcttacctccgcatccatgtcagcagcacctccatgatcgtacggcgccataaatgaaatgtttatggcgctctgctgtttttacccttttcattcacacattaaaactaaaaagatcggccgatgaacatgcagccgatcagtaattcatagattattgtgtaaggtttacatcgatgacgttatagaaggcattggaagtatccgcaacgtcccatacccccaaaatgacatgatacccgcttcgatcagtcggcacaaaaatcttatgagtcagattcgtatctgccttggaaccgtcgtggtttaccgttccgattaattcaaattcatctcttgacaaaggtttattcggattccagtttttcttggtgatataatagtgccactttgatgtcgcatgaggagctgtgtagtaccaagtaaaggtgttaaaaccgccgcggatgttttgttttacccaataatctgcagtctgcttgtctaaaccgaagtcaatttgtcccgatcccccatttgcagacgcaattcttccatccggcggacctgcagccggaaatcctttcggcccttctacagactgaggattatcaatgacggagccatatttctgcgcagcggccgtccagcccaatgtttgtttctctaaagctcccatgtacgctctgctgacgggctcttttatatacccgtgcgcagatgcatcacttgaatagaaagcgcctccaatcccaagagtaacagttaaaactgcagctttgaccaaacccttcattactgcatcatcctcccttttttgttaataaaatccctttcggtatatacacttcacgatagaggatgaaatgaccttccttttcttgataggaaaaagcaatgaggttcgcgctttcccctttgttttttataatcataaagaaaaagccgggccgattctgttgtcgaatccgcgattgccaaaaaccggcccgccccttatgctcagaacttcattcgctggatttgcgggtttcttttcggataaccggtgctacttccgctgctaatcgttcgatgttttccgcggcttttttaaacggcatacctcctatatcgatttgcgcgagaaatcgctgatgcccgaacaactcatattgatgcatgattttttcaatgatctgctgtgaacttcccacaaataaagctgtttcttttccggacgcccgctcaaaatctttcttcgttaaaggctcatcgatcccgtgatatgaatgaacgtgagaccagtaatttgaatgatacgggtaaaattcttgtattgcctgttcattcgtttttgaaatgaacatatgtccggtcacggcaaccttcacattttccggaggatgaccggctttagaagccgcttcccggtatttgtcaacaagcggcttagatgacatcggatcaccgctcagtacagccaatgccaaacccgcacctgcacgcccggctcgttctgcgctttccggagtccccgaaacacctaaccatagcggaatgcttccgcaaaaaggccgaggagaaatttctgcctcgcgcagcggcggccggtaacgtcctttccaggtaaccgattcttccccggaatttaattttaaaaaaaggtcaatgtgttcttcaaacagttctttataatggcctacgtcataaccgaaaagaggaaacgagtctaaaaatgcgccccgtcccgcaatgatttccgcccggccgtctgaaatcagatcaagcgttgcaaaatcctcaaataaacggacgggatctgcggtggataatacagtcgtggcactggtcagcttaatattttcagtaatctgtgaaatcgctgataagatggccggcggcgaagataccgcataatcaagacgatgatgctcgcctaccccgaatacatcaagccctgcgtcgtcagccagtttcgccagcttcatcaattcatctatccgctgctttgcgctgactgttttccctgtcagaggatcgggatataattctgcaaatgaataaattccaatttccatacaatcacggtgttcagccctcacatttctctcctcctgcactgtgtaaaaaagcttttatgttattctattcagccgttttataaataggaatttattcaaaataaatacagaagcttaacatgcagaaggccggtatgagaggaaaaaaagtttccggcgcccttcaattctgcccattatactcatgcagccggactaggcaagaacaaagccggcacaagcggattcgaattcatgtgttcgttttcagtccaattcaatccaatcgtgatattgatcataaagctttcctattcttccggcatcaagagcgatgacttcacaccctctgtcatcatatagaaagaaaataatatcttttgtcatattcacaaagaaaacatcgggatacccaacggaacagccccgaaccttggcttcagcggaaaatcttcgtggacggctgccttaagtaattggggaatacgcagatctttccgtttacataataaagaaaactgctgcatttcatattcttctgcatcatcttcttcaaacggacaggggcaggtcttcacctggatccgatataaatcatccttacacttcagaaacggctgataaacctttaattttctcggatgattaccttgagttttgtgcttatatacgttggcaacaaggaacatgtcatcgctatgttcaaacagttcattgaaaagtgcggcggtttgatgatgaacaagctgaaaatactcaagattcaaagcaccgctttcattaaattgatacatattgccgccgagagaaaaatgaagtcccacgtcccattgatgataaatgccgggcactaattttaaagtcggaaacctttccttcagataatcatttattttcattcaaacatctcactttccgtttcccgctccagagacagaagaagccgaaaacattccgcttatttctttttcacccttgtaatattattccgattggaatacaatgaaatagaacactgtgaaccccattgatcagggtggatgctggtcacattcatcctggtcctttcttttacacaagatcgcaccaactttgatcccctccgtttccaaccttatacatatatttcaatggtattattttcttatacataagcatcaagaggtgtcagctttgaacaacatcagaagatgaagagcatatttccggtctcaccgcaaaatgggtcttgactctgaactgcttttcacattttgattatcaagcgcttctttaaattcatcaaaatgaattgaacattgctgattcaaattacttcctgcaccttctgtcgctaaactgcaaaatgtccgtcacaatcatcctctctctaattttacaacattgctataatgattttcatgtttttcccaaccttcaagctgaatctttttgatcgttactaggtaacctaaatacaaaaaaacctgctttcagcagggttttttcggtaaaggggagattatttccccacaaattctattacctatgtttttgttttaaccattctttctttagcaatgcgtattggtaagtgttttcatatttaggtgttccatcctcgtgggcagtaaatgaaataaattcaagaaaataaccttctttacgcattcctaatctctcacatagtttttgtgacctgcagttatcatcttcaacatatgcataaagccttcttgcttctttttgcataaagagatactcaaagaaagccttcgcactttcacttgcgtatcccgccccttcaaaacgggcattgaaattccaacaaacggaataggtatctggctcttcttttaaataaaatagttctccgactagatcattactgtcttttaaacaaactgcaatataagagtcatctcggcttcttttttgaacatttacggcagcttcttctaacgtagatattctgtcatcaagaaaacaattcactctcggatgtgccgaatattccaacagaccttgtgcatctctctcggtaaaatttcttaaaattaagcgatgggtttcaattttttgcatttgcagtctcctgtttcattgttatcgacctttgaaaagaacttcttcgtttgttgaagaacttatcacaatctatttttactataatgatgggtgttatcatctttgtcaaaaacaataatcattcatttgccgcccgcaatgtaaagtactgaacaattttcgtgaaaaaccctcagtatcgaatataaaaacgagcaatagtaataaaacaaagttaagccattaaaagcttattgagtattttttcaaacttatttacgctcatcatctcatgagtgagaaatgtccccttataaaacatgctgaaagtcgtccaaactgccggggatttttgcgccatatcttttgacgttattctcagggcctgaaaatgaagtcctttcttttcagtcagttcctttaaatgctttaacactccgactgcaaatgggcattgagctgtataaaatattgtgattccctcatcattaacggaattacttttcacctgttttttaaatacaggaggatgtgcatgttcattccacgtcagtgacatcaactgaaaatagggttctgcttcatcttgcacagcaaatcccatatgctcgaagaaatgcttatcacttaaataagggagttttttcttccccactatatgaactatcccatccataccgcgggattttgcatctgacacacatttttctaacaagtgttttgcatgtccgttattcttatatttacctgagacccaaaggcaattaataaacataaaattaggtgcgcttaccgggacccacgcttcttctgcaggtaaatattcaataaaaactttggcccgttcgtttaggcggtagaacaccaagccatcactcatccgatctttgagccagctcttcttttcatttaccgcatcctcatattgtttcgtacctaacgcacagcaaatatgattgtcatcaatattgtccctggtcaactcaatgtattccatttttcctcacccgctttcttttggaaacatcagctttacttccgatgaacattgtaatttctcagaaatatagagtcccagtaccaatatatgaacgcagcagcaatgctcattatgtaataaatgaaacttctgaaaaccgtgaaatcaattgacggattacctatgtgccagaacaagaacacagctaaaaaagcgactgcggtataaatgaaaagatgaaccaaactaaactttttaggcttctttcttagccatagttgcacaggaacagcaaacaaaaagtaagtaatgaatgcgtaaaaagcaatgataactacagtaaccaatgcaattggcacaaaacccgagtatacaaacatatatagcccgaaaatcaaaccatacgacaaacttgaaaaagccaatgtgtaggtatagctctttaatcttgttgaattcagcttcaagtcaccgccccgttcatttacttcgcacttacaatatcgtagttttattgtctatttgtctgttttaatcactatttgacattcaattttataatctgtttctcctgtttcaatctttgtatcatcgcggttaactttatatttccctccatacaaacttgctgatatcgggtgccttataccactctttaactgatcgtaaatgtatttcttgccttcttgaaaattctttcgaggaacatgtcctactttgcaatcatttacatagacagctatagcttccggatcgtacttgttgttctcttctaaccgcaattcacaatttgagaaaaggaaattatgataaataaatatcggctcatcaaaagttgattctagaatctctttatttgtcataccatcatatttttcatcgaagaaaaagctgtcttcatcctcagtcttgatggctttcttaatatctttttgatagtgtgatgttcctgcaaccttaaagtctatatactcgaaaaatgcagacttttcttcatatttccttgagaagcctgtctcttgaatcaagattgggaaattttcttttttcgataccatctctgtttcgttattaacgccaacagtgttcatattattatttttattctcattttgttcatttttaactttgttcttgaaaaagttgagtatacccaaatgtacccctccatttgaaataaaagattggtttaatcaaaaaactcatcatcaataaaatcattttctcttgcaagtttattcgaatcctttttaaaaaacctttgcttcaatttttctttaactgttaatttttgtttttgtcctggcatatatgacatatataatctccgttgtttgataaatgaataagtaatttatcgacacctgaccttttgcagatacacatcctgtgctgaccatcactaaacgaaatatgaccgcaagcatttacgcttgcatatattcctgaatgttttttatgcatgtccggttttatgtagtgcgcagccaatcttctgcattttaatgcatattcatgctcttcgccttctaaagcattaaattccttatcagttaaatctaaggagcactttcctgttctaactttataacagtcatgtttacttagcctaaaataaaaagaatgtttcgtaggatttattaactgatccaacctgatccccttctctttaaaagaatgattttatgcaactccttaaaatttgtatttcgttacttttattgtaactttagtatactatgattacttttaattatcagtatacccataaaaaaggtcaaggaaataccttgactgtgtatcgctcaccaatctgcatccggctcatcgtgttcaaatccgtgaaatccacacatctccgcagccggctccttttgtgaccaataagtaatgatttctgtttgcatcaccattcaccttatcagccgcgctcaagttcaaatgatcacccgtgaaattcttttcactaagggtaaaatcatatcctgacggcgtaattctctgcagtgcaagtcaaatatctatagaaagattatgaccgcaaattcaaagcattctgtgcatttggagatgacaaacccccatttaaacacccttcggatgacaaatcatccgtagaatcctccctgcatagctccctcaatttttgtagagacacttgtccgcaaaaatgtaagggttttcaaaagaagagtcgtgtgctaaattgtaagataagtaaaaattttctgcgaatatttgaaaggggtgtatgatttgaaagcagtagtagcaacaaaagacaaaagtatagcgatcgtacaaaaagaattacgtcctttgcggcatggtgaagccaaagttaagatggaatactgcggtgtatgtcatactgacttgcatgttaaaaatgctgatttcggggatgttaccggcgtcactttaggtcatgagggaataggcattgtgactgagattggtgaaggcgtaacaagcctgaaaaagggcgaccgcgtctctattgcctggatgtttgaaagctgcggccgctgcgaatattgcttaacaggccgtgaaaccttgtgccgtgatgtaaaaaatgccggctatacagttgacggcgcaatggctgaagaagcaatcgtagcggtcgattacgcaataaaggtgccggaaaatttggatcctgcagcagcaagcagcattacttgtgcaggtgtaacaacttataaagcggttaaagtcagtgaaattaaaccaggtcaatggatcggtgtatttggagtcggcggtttaggcaacttggctgttcaatatgcaaaaaacgtctttaacgctaaagtgattgctttcgacattagcgatgaaaaattgaattttgctaagagcttaggcgctgatgcggttgtaaacagtttaaacgaagaccccgtcgctaaggcaaaagaagtgactaacgatttagggcttgatgctgtggtcatcacggctgtctctaaaacccctttcaatcaagcgattgatgttgtaaaagcaggagcccgtgtagtcgcagtcggtttaccggtggacaaaatggatttagatattccacgtcttgtgttagatggaattcaggtagtaggttcattagtaggtaccagagaagacctgaaggaagcttttcaatttgctgcggacggtaaagttgtacctaaagtgacaaaacgcccgatcgaagatgtgaatgatatttttgaagaaatggagcaaggtaaagtgaccggccgcatggttatcgattttacttcctaatcattaaggctgccgggaatgatacggcagcctttaatctctattcttgctcagcgccccacccagactgaataagactttgtcatttagttcagaaaagaaactttacagaccattcggcggacatacattttgcaagtactgcctggactaaccctgataccaatataattccaggtcattcattgccgaagcgtagctgttatgaggaaacccaccagaggttcctcataacactaaaaacctactcactgcactttttacagcagaccttatcagagtgtttgcttaacactttgtccattctacccacaggcatcttcttctcactcggaagtgtaagataagctgttatctcatcccctgattttaatgtttttccgcagatagagcattttaactcagtattaaagaaattttttaatcccattcagaagcctccttatttacctttataaagtaatacgttaatgctttataaaagtttcaggttaaagaaatactccttgtccgggaatttactttctttcagttgttacgtacccgcacagggttaacaatcgtcttgttctttaactcacagtgagaagatcgccttgtaaaacattagcgtaaaatcatcttcatgctttgaccagtttactgcagtgcatggattgttaatttgtgacacttatttgtcctctttaaatttttcttcttctctcaacttgaaaaagaaggaattattttataaatattgtaaatttatagctgtatcacattcactattaagaggaggaatacgaatgaaaaagaaaattattgccggcgctcttgcttttgggttaattccgctaatgggggctgcagatgtttctgcaaaatctttgccaaatcaagataaagtcatgaaacctgccggttggtcatgtgacgctccgtatattgcgtgtcagcctttttctggcggtaccggtaagatttcattcaactatcaaggcagctctccaggaaaaatcagagtttttgtagcgaatgacggcagcaaatctttcaaattcaccattaattatcctaatgggaatacactcttatcctctacgacactaaatgcggggaaaacgttcattcaagaattcagcgttaaccaaaaaggagaatacatcctgaaatatgatagcggcaccggtgatagtgtcgatggtttctttagatctgttgagatctaaattccgttaggaaagtcggcagttttgccgactttcttttccaagcattctgcaggaataaacgtaaagtgtcgaataaacatatgacctttttgaaacggaaactttatctgcaccacaaacccgcaagcagcctccttgtatcgtaccttccgtccctttgtgatttgttttgatttgtcgtatactgcgcttgcccgggaaatgatgaatattttcgttaactataatttccctgtacctcttcgtatgtggctctgcatgatgaagtaacgtcatggctcaccactttcatccacagttttattgcatgttgagccatatccctcctctttaaacagcaaaccgtcccatccatttctctctttccattatttcatattcttagaagctcttcattttagacttaatatccattttttcttatttagacttaaatctatgtcgaaatttatcgtccggcatattatgtactatcctaacaacaggaggtggcaataatatggggaactacggtggaaattacggtggaagttctttcgtattgatcgttgtgctgttcattttgttaatcattgtaggtgctgcattccttttctagcacattgacgatttatattcgtctcccaaacattgcatcccttagttcggacagacgccataagaagttttatggcgtttttactttttaaaaaaatctatctaagataaacattttttattttcactctggtaagcgggagagttttctcccctgcctgcgccaatattgccgctatgaagaataaggtgaacaattcaattcggaataaagacttgttcatgaacaaaacccctaaatagttgttaaaaaactaaggcgtttttaattcatcaggattacagaggttgtgaacttaaaaaggatattactcacctttataaaattgtcatcgttagatttagtcactgaatcttttttgtaagggtccgcccacaaaatgcggtgttcacacattaaatcattttcacataaaaaaaccggattcctcttctaaaaggttccggcttttctttttgttcggtatttgtcagttaatatgcaggaaatatctggtgacgtgcacacacccgctattataatatttcaatagagccttctgttccatgaacgcggattcgctgcccatcttttatcaattgggttgcattttcaactccaacaactgcaggtaagccgtattcacgcgcgataaccgctccatgggtcatcagtccgccaacttcagtgaccaggccttttatggacacaaacaatggtgtccagctgggatcagtataggggtaactaatatatccccatcttccaaatcggcatcttccatgtttaaaataacccgtgccctgccctctatgactcccgaggaaacgggcagcccggcaatcgctccggccgggagattttctcgtttgtactcgcctgtaacgatttcaccgtcagacgtgataacacgcggcggagatagtttttcatatactttgtactcgccttttcgtgtgctgatgatttggtaatccaatttatttgtgcgtacgacttcctgaagttcttcaaaagtgagatagtatatgtcttctttttcatgaataacccccgcttttgcgagttgttcggcttctttcagtaaagcctgcttataaacgaagtagcggctgatcatgccgtattttggatattctctgaatccgctgaagttccggatgatttggatcattcgtttagtttctctggctttttgttcaccgtccggtaattgcttcaatcggtctaataactcttgttctttcttcaacgcctcctgccgcccttgctcaaatttccgctggctggcatttggctcaaagtttttgagattattaagaatcatagggacaagtgcaattggtttttcgctccatcgagttcttgtgatatcaatttctccggcacatcgcattccgtacttgttgagataagcatagatagcgtcatgggtttcccgcccgccttcaaacttcaccagcccatccaaaaagtgatcatcttttacattctctaaataggcaattacttctggataaggacggatcacatcggcgacgtccaatagcgcaagccccatttctgaagtaatattatgaggtacagattgagaaagcgtatctgctgcgtttttttcacctaaccactcgttcattttttcgttaatccatgatgaagcatccattgcagttcgaatcagcaccgaactttttggattaaataaaatattctttaattcctggatatcttccaaaataaaacgaaataaatcagatcctgatttcgtctggatgttttgttttaactcttctatcgatgcctgactgctcttaatcaaatcagaaacaattgcaggatcgttttcagcttgatccggcatatctgcattgcctttgccgggaatcggcgccgttttatcatgtatcggtttaatgaaatcatctcgctctattatggtcataagtgcgtcttttaagagcggatcgtgctgccccataccttttaagaaaacttctctgacattaggggatgccagttgatgtgtgacatcgacaaatagccttccgccggctttacgcatgggtgcagcagtcgtcaacagaaaaaaagacaatccaaggggttttatgggatccgtcatcatttgctgatgaccgacagagatatagacgtgattttcttgatcgttcgcttcaggaacggggtataacgttgtgatcggacgactttggacaatataaaaagtatcgcggtccaaacaccattcgatatcttgcggctggccgaaatgagcttcgatctgtctcccgatacgtgccagctgtaaaatttgttcatcagtcagtgtttgaatcttttgctgatcaagatcgatctcccgtgtttccgttccgccttctcttcgttcatagacagccttttttttggtttctattctcttatcgacgatttgcccgtcctgtactttataacaatcggcagatactaagccggagaccagtgcttcaccaagtccaaaaccggcatcgatggacagcagctttcggtttccggtcatcggatcagcggtaaataaaatccccgaagcctgggggaacaccatcctttggatgataacagataaataaacttggctgtgatcaaacccattttgcatacggtaaatgaccgcgcgatccgtaaatagggacgcccaacatttactgatatgctgcaagatcgcatcgacgccggtaatatttaaataggtgtcttgttgaccggcaaaagaggcatgcggtaaatcctcagctgtcgcactagaacgtacggcataggcatgttcttcgccgaaccgggagagatggcaagcgactgctttgactacatctgaaggaatttctgcttccataatggtttgccggatttttttgctgacttcaccaatttgatcccgattctccgctttcagcatggtcagttgacccaacagcgcttgtaacgtttcgttttgttcaatggcttttcgatatccggcggttgtgacacaaaatccttccggtacttgtattccttgaatttttgataattcccctaaatgtaacccttttcctccaacgagcaaaggctgtgttttttcaatttcgtgaatgccgagaaccaaagaactcattctatatctccccttcaaaaaaatttgacaagagcttttcagcatgatataatcataatataagatggataactatgacttttaacacagaaagcgcgcgtgttctgattatatcaccgtgtctgtttttgtgcaatataaaaagaacctggccaatttggcgaggttctttcttcattttctaaggaaatcctgaagttgagtgatacctgtgaatccattgcagaaaggctatccccacggattcaagaaacaggaaaatctcaataataaaaaacatcccccacgcaatgtgaggggatgttttgtgtgtatacttctcatttcatcgtcatatgagtttagactgatgcagtcacaacttacaagaatgcttatctgtttccttcaatagtgttaacacatttgaagttatattagcgctgccgctgctttgatatccctaaactgtaatcgcttagtgtattgcgcgggagaaagaattgcattccatggtttattaatgccggctttctcatttgttaacagatttataaaaccaaggccattgataatgagtggccgtttattgttcttcctttgacctcctgaaaattaggtttgtctaaagctctttaaagctgtattgatatcttttgtgtgaacgtaaatgttcttatacaactcgaatagtgttttatatttttgaacattttgttcttttggataaaatgcagctgcttcatgaatgaactgctctgcacattcttcaagagagtcaaaccacccgcttccgaaggcagctaacatcgcagcccccatggccggaccttgttcattttctaacttaaccaccctcgtattgaaaatatcagcctgcatttgaagccacgtttcatttttagctcccccgccaatagagacaaccgtatcaactgattttcccgcttcgcggaatagctcaattgattcatataaagagaatgtgatgccttccattatcgccctcaaaaagtgctctcttttatgggctccgtccattccgatcaagcttccccgaatagatgaatcagcatgcggcgttctttcaccgactaagtaaggagtgtacagcagtccatttgctcctatcggaacagattccaccccccgcaataattgttcaaacgattcgttcggcgcaaacgttcttttaaaccagtccaagctgtaccctgcagcgagcgtgacccccatcgtataaaaagaatccttttttccatgattaaaaaagtgcactttccctttaaaatccctttctttgtcttcttcacaggaaagtatgactcctgacgtcccaatgctgcataacgtttttccggaagaaagaataccggctccgacagcaccgcaagcattatctgctcccccagcgtacacttttgttttttcgagcagccctgtcttcgccgcaacgctcggaagcagcgatcctacacagtcatgggattccacaagcggaggacaaatttctgctgaaataccaaattgattgcaaatctcatcgctccactctttgcgggtcatatgtaaaagtaacgttcccgccgcatcggagtattcggtgtgaatggcgccagtcatgcggaatctcacatagtctttcggaagcagaaaaacagcggttttgttaaaaagttcaggctcatgttccttcacccataacattttaggtaatgtaaacccttcaaggacacgatttttgtgatatcaagcagatgattgccaaatgtctcggttatcctgctgcattgaggcgtcgttctggtatcattccaaagaatcgcatgacgcagcacccgccgatcttggtcaagcagtactaatccatgcatttgtcctgaatagctaatcccgtcaatatccccggcttgaacgttggatatcgaaatcaattcagccaacgcttcaattgtttgctgcacccagtcttcaggattttgctcactatatcccgccttctcttggatgagcgggtaacttttggacgtttctgcacaaaccttgccgttttgattgactaaaatggttttaacagcactcgttccaaggtctattccaatgacatacttcattttttcactccttcctctctaaatagatttccgttgaaatgacccgccataacagtaacttcatgacgggcaattccgggaacttggctgcctgcatcttttatgcgggatctggagcttcttttttcatttggttatacctgtaaaatgtattggtttaatatcgcttttagccgttcctgtctccctgattcgtttttaattggctgattgttcagcgcatattgctcaagtgtcttaaaatcagctcttccttctgcaatttcaagaccaatcccttcagtaaagctgcggtaacggtgttgaatcacatcttcaaacacacgatcttcgattaatttgtgggcggctttcaaccctcttgcaaatgtatccatccctgcaacatgggcatatagtaaatcatcaggctcaaaagaagatctcctgacctttgcgtcaaagtttaatcccccgcttccaagaccgccattttgcaggatttcgtacattgctaatgtcgcagaatataaatctgtcggaaattcatctgtgtcccatcctaaaagcggatcaccctgattcgcgtcaacagagccgagaaggccatgcactctcgccatgcgtaattcatgttcgaatgtatgcccggctaatgtggcatgattggcttcgagatttaatttaaaatgattgtctaagccgtattgctttaaaaaggcaatggttgttgctgcgtccgtatcatattgatgggtggtcggctcttttggttttggttcaatcaaaaactgccctgtatacccgatttccttcgcataatccactgccatatgcataaatctggccatattatcaagctcaaattttaaatcggtatttaacaaagtttcgtacccttcacgtccgccccaaaatacatagttctcggcgccaagctcttttgctgtttctaatcctttttttacttgggctgcggcatacgcaaatacatctgcattacaagaagtcgccgcaccatggacgaaacggggattcgtaaacatgtttgcagtattccataataacttaacgccgctggttctcatgtagtcttttatcatgtccacgattatatccagattttgatttgtctcttttaacgtacttccttccggtgcgatatcccggtcatgaaaagcaaaaaatggcgcatccagtttttcaaacagctcaaacgctgcatctaccctcgctctcgccagatccatgcctttatagtgatcccacggtctctgcatcgtagctgcgccaaaaatgtctgtgccgtcagcggtaaatgtatgccaataggcaatagaaaatcgcagatgctctttcatcgtttttccgccaattacttcttgagaattatagtatttaaatgctaaaggattcgtggattctttcccttcgtaaatcactttgtttacgctttcaaaatagttgactgaaccggaatgagagtgagccatgtgtgatttcccccttaaaaataaattctaaacttgatgattcgaatacagatgattttatgtcatgttatatattagtttgttgcctaaacaaactaacttattttcatcttatataacctcatcagtattttcaatattttttttagttttttacgaacacattagatataataaaggttggattcgctatgtactgcgtttcgcacgataacacagaacgttcaacttaatttaaagattatacaaacggagtggatgaagtggatatcgctgatcaagcctttgtcaaaaaagttaaccaaaagttattactaaacgaaatacttaagaattctcctatttcaagagcaaaattatctgaaatgaccggattaaataaatcaactgtttcatcacaggtaaacacattaatgaaagaaaatcttgtatttgaaatcggtcagggacaatcaagcggcggcagaagacctgtcatgcttgtttttaatagaaaagcaggatactccgtaggaatagatgtcggcgtggattatgttaatggcattttaacagatcttgaagggacgatcgtccttgatcaacaccaccatttggaatgcagctctcctgaaataacgaaagatattttaattgagatgattcttcactttattgcaaatatgccgcaatctccgtacgggcttattggtataggcatatgcgttcccgggttaattgataaaaatcaaaaaattgttttcgctccgaactccaactggagagatattgacttaaaatctttcatccaaaagaagttcaatgtgcccgtttttattgaaaatgaggcaaatgccggcgcatatggagaaaaagtatttggtgctgccaaaaatcacgataacatgatttatgcaagtatcggtacagggataggaatcggcgttattataaacaatgatttatacagaggggtaagcggattctctggagaaatgggacatatgacaatagactttaatggtccgaaatgcagctgcggaaaccgaggctgctgggaattgtatgcttccgaaaaggctttattaacatctcttcagacaaaagagaaaaaagtgtccactcaagatatcatagacctcgcccatctgaatgatattggaactttacatgcattacagaattttggattctatttagggataggcctgaccaatattttaaatacatttaatccgcaagccatcattttaagaaacagcatcatcgaatcgcatcctatagttttacattcaattaaaagcgaagtatcgtccagggtttattcccacctagacaatagctatgaattattaccatctatcctaggaaaaaacgcaccggcattgggaatgtcctctattgtgattgatcattttctcgacatggttcataactgaaatgtacaaacttctatgttttacgctcatctttaaagatgggttttttgttttgttattttcatcctgaatgggagcatttctgacgtgtttttccacacgggcattttctaatatgaaaaaggagttccaaaatagaaagctcctttttcatgcggacattcatttttctttataacggaaatatctgaagtcggccggaatatgatttccgctcgtatcttggcattgcatccctacaaaagctcctgtaaagaatcccccgccgcggatgtaatcatctgataatttttttgattccaatgcaatatcgattttgtaccaatcttctttgttaaatgaatagaaataataatatttttcgttttcaatattcacttttaaatagacgtacttgacttcacgaggaatcacaattttattttttaacggttgtgaaaaagagaagttatcacatatcgttaattcaagaatacggccaagttcttcatcatgcgtgacttgaagagccgtccagttctctgtattgtaatagttcaccaaaccagcggcttgctgaaaattttccggataaaacgcaacagccgtttccgcttcaaaatggagactttgccagcgtctggctacaaatgcctgagtaaatgtcgaagttaaggattcatggccgtataatcgtaaatgatttggcgcttgagttaatgaacctaatttctccgtaaaagggattcttaacgtttgaaaattaatatttaatgtcgcatcctcaaattcatcaacttccggatacgtgtcttcaaatatggtttcaggtatagaagacgcatccacctccaagctcccttcttttccgccttctacataaggccagccatctttccaatagagcttttgaatagctgtttctctgcccaaaggacaatatcctcgctgctgaaaaattgaatcatcgtccgggtgaatgggacgtcccgttaaatgagctaaataccactcgcctgtatgtgtgtgaacaatggatgcatgcccgcatttttgcaatgggtttcctggatcatgccatgacgttaagattggattatcgggatgaacttcatatggccctcgatatttgcagaacgggcaattgtagcagcgtgttcgaaccgcgttcctccttctgcggttaataaataataatagttcccgatatgataaaggtgcggcgcttccgtcagctttctttcagttcctttaaatatcactttcggtttaccgatcagtttttgctccttatcagaatattcctgcatgacaatgcctccaaaggagtgccgatcaatacgctgatcccataacatatttaataaatatttttttccatccgtatcatggaacaaagaagcatcaaaccccgagctgtttaatgtgatcggctccccccaatcaccatcaatcgtgtcacaagtcactaaataattgtggcaatctttccaagcgccatctacgaccttaacatccgtatagatcagccaaaactttccgtcgctgtaacttaaacatggcgcccagaccccgcctgaattaggatttcctttcatgtctaattgcgaaactctctgtaatggatgtgcaactaagtgccaattgactaaatcttttgaatggtgtatctggactcccggaaaccactcaaatgtagatacagcgatataataatcctctcccactctgcaaatactcggatcggggttgaatcctttaagtactggattgataatcttcatgcagaacgcctcctcagctattttctgttgactatcatgttttaagctttgaaatcgtcaatatgatccaaataaactttgtctctattctctaattctcgaaccatgtttttatattttttctcatctaagttatagaaattaatatcaatcatggccagaaccagtaagaacacgggaataatggttgctgtaattaaaattcccgtcaatgcctccggcgtttgcgcctgatttgccacatatccaaactgatctagaaccaaacccggtacaacccctcccaaggccatgccgaatttaaagaaaaatccgataatagcgtatatgagaccgcccattcttttcccggtcttatactctccatattcgattgtttcaggaataagcgcccacatatatcccccggcagtgagacttcctgcagcggccagcaatcgaaaggaaagtatcaggaatacattacttggcggaacaaacagtaaagctaagaggccgatcatattcagtaataatgcatagtttagtaatttcttcttccctaataattgatgaagctttggaataaacggtaaaatgaccaaagcaggcaaacttcccaacaaaccgtaccacttcactaaatccgctctttctaaattatacgttacgtaatagatgccaaccgaattactgattgaattcactccaaaaataataataaaaaaatacttagtacaactagaggccgattaacacgaaattgctcaaatatatccgataatttaattttttcttcagatttttgaagcgtgacacgctcttttgtgcttttaaaacaaaagattaaaaggcacccgcctataactcccataatacccatggttagctgccagccaagagattcgctgccggacgtatcgcttaaataagcagccagtaagggaacaaaaaatgcaacgacaagtccccaagattcgcaaataacatacggacagacgttatactaacaacttcttgattatttcgggtcattgcagaggttaacgcgccatatggcacgtttatcattgtgtatgtaagcgataaaccgacataggtgatataggcatatattaatttcccaatatccgaaaaatccggggttgtaaaacagagtattgccagtatgacaaatggaaaagctccgaataaaagatacggtctgaagcgtccaaacctgctatttgttctgtctactatcgttccaataaaaggatcagcgagagcgtcgatgattctaaccactaaaaacatcgtaccggctgttgctgccggtaaaccaaatatatctgtatagaagaacaaaagataagtagacactgttgcataaattaaattacatgcaaaatctccagacgcatatccaactttttcaaccatgctgatcttctttacattttcactgagcatgatttcctccccttttcgatcctttacataaggaacatgatgaatggtataacatttcttcaattttatcggccagtgaggtctttataaaagcgctttcaaaaaatgatagcagtttactttcacagagcactttcatcgtagtgaacaggataaaagcttggctttcgttttatatatacctccaattaaatcgagcctcttatccccttccatttaagacctttacatgaaggacaattaaagcggtttattagtttgttgatcgaacaaactaacttgatttcatattataaaatcttttctgctttttcaactcttttttcagaaaatttaaaaccgatcaaaggacataccatgttgtaattgccggctccttcgacagacgttaagtaaaaaccctatgtgtcacctgactgatttattaaatgataagcacttccatcatcttttgtttagaaaaacttattaagaaacatgcacttgaaaaaatgcgaatcatatataagtgatatcccgtttaattggttgaggaggatattatgaaacctatgctgccttttgaaaaatattttggtgatttagaactggtttatgcattttatggagctatgcctaccggtgttactgtctcagaaaccggtcgtatattcatttgttttccgaaatggggagacgatgttaaatttacggcagcggaaataattggagataaattgcagccttatcctgattcacaaaccaatttggttaactttgagaatatcaaaatgactttcatcagtgtccaaagtgtagttgctgatggaagaggaacgctttggatactagatacagcggcgcccaatttttctgaaccaattaaaggcggggcaaaattagtcgctgttgatttaaaaaccaatacaatcagaagagtgtatacctttacagaagatgttgtccttccaacaacctacctgaatgatgtccgatttgattttcgtgtcggaactgcaggttatgcctatataacggattcttcttccaaaggaccaggagctattatcgtcgttgatttagaaaccggaaacgcatttagacggttaaatggagcaaatccaacttcaccggattcctcttttataccgaaagtagaaggcaaaattttgatgaatcgtaacaaggatggttcaacttccccatttaggctggcatccgacggtattgcgatctctcccgacggaaaggtattatttttttgtcccctgaccagccgccatttgttctctatctcaacagaagccctgagagatagaaatatatcggacatggatttactttatcatgtggcgtattggggagaaaaaggcgcgtctgatggaatgattacagatgcaaaaggagccgtttatgccggagattacgagaacaatagtattcgaaagatgctgccgaatggcacaatggaaaccatcgcacatgatccgagaattttatggccggatactttttcgattggtccggatggatacttatacgtcatcgtgaaccaattacatcggcaggctagttttcattatggagaagacttacgacagaaaccttatagtttacttcgtatcaaaattgatgaatttcctgctcctgctttttgaaaataaaaatggccggttcaattttagagcataattggcttcatttagcctccatcctaaaccgaataagggattacaataaatacgtgtcctcaattatggagttagattcataacttcattttttttggtcaaggaccaaaatatcgacctcttaaccttttgaccaaaacttaaaaaatcccctgacaccaatagtgccaagggattgagagattaatactgagacatgtattgttcgcgctcccacggatgaacctgtgtgcggaacatatcccattcgatttcttttgcttcaatgaagtgttcgaacaggtgctcgccgagcgctgcaaccatgacttcgtttgatttgaattcgtcgagagcttccgccagtgtcgccggaagatctacgatgccgttttccatgcgctcttctttgctcatgacgtagatgttgcggtcaatcggagccggtgcttcaagtttgtttttgattccgtcaaggcctgctgcaagcaatacgcttaacgccaggtacgggtttgccgccgggtctacgctgcggacttcaacacgcgtgctgatgccgcgggaagccgggatacggatcagcgggcttctgttttgcgcgctccatgccacgtagcaaggtgcttcatagcccggaacaaggcgtttgtaagagttcactgtcgggtttgtgacagccgtaaagcttgtcgcgtgttttacgataccggcaatgaaatgttttgctgtttcactcagctgaagatcagcgtctttatcaaagaatgcgttaacgttatctttaaagagtgataggttgcagtgcataccggaaccgtttacgccgaacagcggttttggcatgaatgtcgcatgcagaccgtgtttgcgggcgatcgttttgacaaccagtttgaaagtttggatgtcgtcacaagaacggatggcaccggcatatttaaaatcgatttcgtgctgaccaggagcaacttcatggtgagatgcttcgatttcaaagcccatttcttcaagctcaagcacgatatcgcggcggcagttttctcccaagtcagtcggagccaggtcgaagtatccgcctttatcgttcaattcaagcgtcggttcgcctttttcatctaatttaaacaggaagaattcaggctcaggtccaagattgaaatcgctgaaaccgagttctttcatttctttcagaatccgtttgaggttgttacgcgggtcaccttcgaacggcgtgccgtccggattgtaaatgtcacagatgaagcgtgctactttacctttttcagccgtccacgggaagattacaaatgtgttcagatcaggatataagtacatatcagactcttcgatacggacgaaaccttcgatggaagaaccgtcgaacatgcatttattatcaagtgctttttcaagctggctcacaggaatttccacgtttttaatcgttccgagaatgtctgtgaattgaaggcggatatactttacgttttcctcgtttactaattttacgatgtcttctcttgtgtactttgccatttcgtaaaactcctcctctaaaaggtaaatgtatatagcaaaacagttgctaacggattaatgaaagaatcgggacatgtcaccttggcggaaagtatttccccgctggaaacggcctgcctgcatcagttcgtttttcagaagctttctgagttcgtcatcagacagattgtgtttcatcggtttggcggttttttcggatttttcttccggttcggcagatgccttatccagaatttgtttgatccccgccatattgacgccttgttcaatcagatttttgatttctaacagtttatctacatcatggaatgaaaataatcgtctatttccttcgcttctcgctggaaatatcaatccattttcctcataatatcgaatttgccgggcagaaagttctgttaactgcatgacaatcccaattggaaataaaggcattgagcggcgaatgttatcactcatctcaatttcctccttttcttatcttagtctcattataggtgatgttatattttgtgtcaacacaatgtaaggaatcttaacatcaaattctttgaaaattgcaaacgccctaaatcagctctttttccattaaagcatttacggcgctgcaaatcgcatttttcacgtgcgcgtaggttaatcctccttggacatacgcgacataaggcggtctgataggtccatctgctgataattcaatgcttgctccctgtacgaaagtgcccgctgccataatgacatcgtcttcatatcccggcatatagctcggataaggcgtcacatgcgcattaatcggtgatgcatattgtatcgcctggcaaaaagcgatcatcttatcagggtcctgaaactcaactgattgaatcagatccgttctcggcgcattccatgcagggtttgacgtaaagccgagcttttcaagaaaacgggcggtaaataccgctcccttcaagctttgcgccactacatgcggagcgagaaagaaaccttgatacatttcctgcagtgaataaagcgaagcaccggcctcacttccgattcccggggaggtcatccggtaagagcaggcctcaatccacttggctttccctacaagatagccgcccgttttagcaaggccgccgcccgggtttttaatcagggagccggccataagatccgctccgacgtggcagggttcccgctcttctgcaaattctccgtagcaattgtccacaaaaacaatgacatcctctttgatttcctttacgaaacgaatcatctcttcaatttcatttattctgaaagatggacgattcgcatatccttttgaacgctggatgccgatcacttttgtattcggccggattgcagcccggactgcttcaaagtccactctgccttctgatgttaaatcgactgcattgtatccgatttgaaattccttaagcgagcctgaatactccccgcctcttactccgacgatttcctcgagtgtatcgtaaggcttgcctgtgatataaagcaattcgtccccgggtctcagcacgccgaagagcgcgattgaaatcgcatgcgtaccggaaatgatttgcggccgcacaagtccctcctctcctccgaacacatcagcatagatcttctccagtgtatcccgtccgatatcatcataaccgtatccggttgaaggcgtaaaatgcgtatcgcttactttatgttttctgtagctttgcaggactctccattcattccgttcactgatttcttctattcttttatgaacggcggagatttccgcttctgtttcttcggcggttttttgtaaaagagcgccgtgggtcagtgtgtcaaacatgttgtgtataccttccttacatgaatttcttcaattctccgagtatgctttgttcttcctgtacataacctgagacttcgtagcgttcattttcttcattaaaataaaggctgtcgatcatggtctctgatttgatgcgtgacatcaatttgccttcggcggcaggcacatgaacttcatacggtgtcatcagctcccggcgcaaataagcttcgatttccgcttttagtttcgcttcatccccggcgattcgggcgctgatcatgatgtggccttctcccgctgtcgggatgaagtcaggaagtgtctcatcacgtttgttataagcggtcagcaccggaatatcatctgcctcaagctcttttaacagtccgaggacagtctgttcatgcccggcataatcttcattggatgaatcaatgacatgaatgatcaagtctgcttccttcacttcctcaagcgttgaacggaaagcggcaatcagcgtcgtcggcagatcctgaatgaagccgaccgtatcagacaaaaggacgctgtagccgcttgggagcgccatctttctcgtcatcggatcaagtgttgcaaacagcagatcttcttcatagctgtctgagcttgttaattgattgaaccacgttgattttcctgcattggtataaccgacgagtgcagcctgaagcacgccgttctttttgcgtctctcccgataacggcttctgtggcggataaccgttgacagctgcacgttaatttcgtgtatgcggtttctaatgtggcgccggtctgtttcaagctttgtctcaccgggccctctcgtcccgattccgccgccttgtcttgagagattgattccttgtccgctcagacgcggcagcgcgtattgaagctgggccaattcgatctgaagctttccttctctcgtcttcgccctttttgcgaatatatccaaaataagctgcgtgcggtcgatgatcttcgcttcaattgcagtggcgagtgatttaagctggctcggtgacagttcatcattaaaaataaccagatccgcttcaagctcttcacacagcgccttcagctcgtctactttccccttgcctatgtatgtagcggcatccgctctgttccgtttttgcgtaatccgggtcagcaccgttccgtcagccgtttttgtcaatgaagcaagctcttccatggaatgttcaaagtgctcatctgtcatgtgcggaagctggcagccgaccaaaatgaccgtttctttttttccttcctgttcgttcaaatggatgttcctttctgtgtcgtattgggcagtagtactatcataccaaacccgcagggcgtataccacacatccggcgggttttaaagagagaaataaaaaagagacccctcaaaccggctgagaggtctattcgtgagctgccgcctcatcttttataagtaaatcctggctcttgatcgtcattaaatcgtttttcaagtattggtctcccattaaaagtctcatggcctgagcgcggatcgatttttcaatcacgtttctgacaaagcgcccgttgctgaatttaatggggcttgtcgtgcttttcactgtcattaagtaatcttttaacttccactcggcttcctggcttaattgatactcccgctctgctatcatgcgctttgcgatgtccatcagctgagtgacagagtaatccggaaaatcgatgctgatagggaagcgcgattgcagaccgggatttaatgacaggaaatgtgtcatttctctcgagtaccctgccaggatcagaataaattcatgctgtttgtcttccatatgtttgacaagcgtatcaatcgcctctttaccgaaatccttttctccgcctcttgcaagtgagtatgcttcatcaatgaataaaatgcccccaagcgattttttaatcagatctctcgttttttgcgccgtgtgtccgatgtattcaccgacgagatcggcacgttccgcttcgatcagatgtcctttggaaagaacgttcatctcgaagaaaagcttgccgatcagtctcgcgacggtggttttcccggtgccggggttccctttgaacatcatatgaagagcttgttttccgactttcagcccttgttcggcccgtttttggttgacgaatatccacgcgtaaatttctttaatgttgcgtttcatttcttccatacccactaatgtgttcatttctttttcaatttctttcagaatgctgtgcttggcttcatttttttgcagggcggcctgatattccgcctcagcttctgcatttgtcagcacttgcttttggccattaagaatgatgttaatttgtccgttatttttataggttacagcgcgctccaacatgctcacctctctgttctctctttatcttactcatgatgaagcggttctgtgacatccgcctatcatcatgaggcccgttttcctctttatctgtcactttttccgttctcttcgggaatgatgttgaatcctgcgctttcccgagaaatatttttcatttcttattgtattcagcaaaaacgggaggacaaaccatttatttttattttccgggaaatgttgggtgtatttctcatttttttcatgaatgacagccgtacaagcaccttttgaatatcatcatatgctgtaatgaggtgatggagaatggttaaaatttttatagaccccggtcatggcggaactgattcaggtgcaaccggaaacggacttcaggaaaaagcggtcacgctggagatcgcactggctttgcgcacgattctgacgaatgagtatgaaggagtttctgtcacgatgagcaggacaagcgataagacggtcagcctgacggaaagaacggatgccgccaacagctggggcgcagattattttttatccattcatattaactcaggaggcggaaccggattcgaaagctatatttaccccggtgtcggagcgccgacctcgacttaccaatcagccgtccacacgcaagtaattcaagcatcgggttttaatgaccgcggaaaaaaaacagccaacttccatgtgctgcgggagacaaggatgccggcgattttgacggagaatggttttgttgatacgtcagctgatgcaaacaaactgaaaacagccagttttattgaaagccttgcaagaggacatgccaagggcttggagcaagctttcggtctaaaaaaaaaggctgacttatataaagtgcaaatcggcgcattcaacgtgaaagcaaatgctgatgcgcttgccgccgatgcggtgtctaaaggttttgacgcgattgtgcttccaaaaggcggcttatttaaagtgcagatcggcgcattctctttcagagattatgctgaagcgttggcagcgcgggccgaaaaagccggatttgatgccttcattgtgcaagactaaatgaaaaaacccctgctctccctttttgggacgaacgggggttttttgttattgaagtatatcggcgacaaaccgagaccaagcttcaagacgatgatacacattttcctctttcagttcgctcagtttcatccagcgcccggcgatttgatctttttctttcacttcgacttgtgctgcaggcgctaactggagcgcagaaaggatgccgatatgcaccttccctacatcgttttcatcatcattgatcaggccgagtgtgacaatgttttgtttgtcctcctcgcgaatgtacaattcttccgccagctcccggtcggtgttctgtttcagcacttccaaaaatgaagccgccccttccatagggttcatgtgtccgccgaagccgagagaaagcttattatggaggcgcgattcccctccgcccgcgagccgttcatacacaaatacctcatcatcgcggcggatgacgacatacggaatcggctgtttaaatcgcgggtcctcttccgcgtcgcctcttctgatttcaaaaaaatgcgcctcaatttgagccataatttttatgatacgttcatcctcgctgttgactccctgaaatgtcagcatttcgttttgaaagacgtcactccgcggtgcagccaagatgatttcatccattttattcatgcccgttcctcctgtcttacctctccactcaagccaaaagagcagatattatatctgctcttcatcttggccaaaataaaaatcttcgtccttaatcggttctaccgtcgcctttttgtagccgttccctttcatggagaagaaatcatgtgattttgttttggtgtttaatccgtttaatacaatcggattaatatcctcttcttcaaagtaaggatcgaaccctaagttcatcaaagctttattggcgttatagcggatgaatttctttacgtcatgagacagcccgacttggtcgtagagatcctctgtatattcaagctcattgtgataaagctcttctaaaagctcaaccgcaaattcgcgaagttccgcttttttcgcttctgtttgtttattgaatatttcctgggccagcagtccgacatatacaccgtggatcgcttcatcacgaagaatcaggttgatgatctcaccgctttgcatcagttttccctgtccgtaaaaatataacggataatagaaaccgctgtaaaaaaggaagctttccagatagacagaagcaaccatcgctttgaacagtgaaatttcatcatctttttgaatggctttgtaaagcccgacaatcatttgcgcttttttctgcagatatttattctgctttacccattcaaatacttcgttgatcgtttcagtcggagcaagcgtcataaaaatatttgaatatgattttgcgtgcaccgcgttttccatcatcgccatgaaattaagaaccgcttttcgctgatggccttcgacgtgctcggccacaatcggcatgcctgtgttcccctgctctgtatcaagcagtgtcaggccggcgagcaccttcatgtacgtatcctgctcatttttacccaaatacttccaagtaagaagatcgccgtttaatgcgatctcttccggaagccaaaactgctttacgttttggttgtagaacatttgggtgaaatcatcttcatgctttgaccagtttgctgcgtcataaatttttgtcactgttaactctcctttaatcaaacgacacaagaaagacagctgtcctgcccggtatctttcgttcttgcatagtaaatggttttgatgcctctatggtgggcatacagatcaatacggttcagatcacgagttgtcatcgtatctttcaaaaacagggtaaagctgattccctgatcgatatgctgctggattgtcgcgatcatatccaccactttgaacatgtccatatcataagcttctttgtagaagaaccagttattagacgctaaccccggcatcgggtaatacgtttttgaatttccgtatgttctttcttcgatccgttccatgatcggcataacggacgccgtgctggattggacgtaggaaatggagcctgtcggcgcgatgcacagtctgtagctgtggtacatgccgttttcggcgacaaacgccttcagctctttccagtcttcgattgtcgggatgtgcatgccttcaaagagcgcagcgattttttcgtatgccggtgagaactctttttcgatgtatttattgaaatattctcccgttgcataagtggagccttcgtaatgctcaaacgtttcgcctttttctttcgcaagctcagctgaacgctggatggaataaaagttcaccatcataaagaacgtattcgcaaaatctcttgcttccgggctttcataagcgatgccgttttgggccaggtagccgtgaaggttcatggcgcctaaaccgatcgacttcatcgctttgttcgcgcgtctgactgccggcgcgttgcggatatccgtcgtctcagatacatgagtcagggaatccgtcgcgagtttcaccgtgcgctcaatcgatttatgtttcatgacattcaaaatatttaatgaaccaaggttgcaggaaatgtccaggccgatttcgtcttcctcgtcataatctgtgtaagccgaaacctgtgacgcctgaagcacttcagagcaaaggttcgagaatttcacttttgatacgtggttattcgcatgctctttgtttacgttgtcctggaacataatgtacggataacctgactcagaacggagaacggcaagcttttcaagcaatttgcgcgcattcactttttcttttttgacacgcgggttgtcaacaagctcctcatacatcgccgtcatgtccatctcatccatatgctggccgtattctttataaatcgtgtgcggatagaatacataagccgctttgtcctcacgtgcaagctcaacgaacttatccggaatgacgacaccgatagaaagcgttttgacgcgcacatcttcatccgcagaaatctttttcgtatcaagaaagtcattgatatcgcggtggaaaatgtttaagtacgccgcgccagagccttgtctttggcccatttggtcagcgtaacggaacgcgttatcaagaagcttcatgacgcctacaacaccttttgtggcgttttcaacatctttaatcgcttcacctttcgcgcggagcttggacaggttaagagaaacaccgccgcccagtttagaaagctgcatggaaatatcgatcgcccgtgaaatatcgtttaaggaatcattgacttcgagcaagaaacagctcaccagttctccgcggcgttttctgccggcattcaaaaatgtcggtgtgctcggctgatattcctgattgatcatcagattcacatattcttttgctttctcagtgtcgccatttgcgaagaacagcgcaacaattgagatccggtcctcataacgctcgaggatttttttcttgtcattcgttttcaaagcatagtcattatagaatttaaacgcactcatgaaggaaggaaaacgaaacttcttagcgtaagctgtcttaaacacttctttaatgtcttcaaaagaataaaggcttaagaattcctcttcgtagtattggttttcaatcaaataatccagcttctcttttaaatcgtgaaagaaaactgtgttttgattgatatagtctacaaaatagctatgtacagcctctttatctttatcaaactggaattttccatcttgttggatcatgatttcgttatttaactggatccattttggcacttgattttgtgacaactctttctacctcctgagtaaacaattcaacgtctttagatgtgccgctgagttcaaatttgtgcaagatcggcacctgatattgtctagagatggtatcggcgctttttgcaaagttatcgccccatactttgttgccgctcgcagcgactcctaataagagatgggcgtatttttcgagaaatgattgtgttgatgccggtacctgaccgaagtttgtcgtgtaggtgaccaaaacaaacggagtgtccacgtggtccatttcgtccaccttgcggatcagctgaaagtctgttttattcacaaaacgctgaacattccctgtctttgaatcaaatatgatttgaaccatccttatcacgacctatcaaaaataatgaatctcttaacactatatatagtatactaacctctcagaaaaacacaacatattgagatcgatttataaaaaattcatatttttgaaagagcggactttggctccggcccgattaacgcccaaaaaagagagcagaacgagaatcatctctcatcctactcaaggtgtcatgtgtaagccgatgtctatcataacatgaaaaaaaactgcttagtagtctagacttttattcttattttttgtaagaatcacattttttttcgctttcaacggtttcttcaatctctacatcagcaccgatttctttcagtacggctttcagagcgcttgtgatggaagcctccctgatcagttctttgccgtcaacgatgatgctggttccatattcatagcaggaatcatcttcacaagtttcttcccaatggttgattatcaccttgtgtttcaatcgtctcaccctctgcatgatcaatgtcagtacttagtgtagcttgtgcggcccgctttgtaaattcgaacgcttgtgaaatttattcaagctcatccagcgccgtttcttttttcagttcgattttattcgttttttcatcatagcggtatatttttagataaccgccctcgacaatgccgaaacgattatgttccagctgcaccatgccttctgtctgcgattcggcatccgccaagccgccgtcatcatccgtcaccaccgtctcgtgattgctgcaagctccaaacagcaaaaaaacagcgatccaaacgagcgtaatcctgattcttctcagttcattttcactttcgaacacgattttccgaacccccttttatctttccgatatacggcctgcaatatacagacgcgcatagaaaaagaccattgttcatggtctttgtcaaaaagtctattcaagctcaagctggacgtttttttgcggggcgaacgtggagatggcatgtttataaataagctgctgcttcccctccgtttcgagcaaaacggtaaagttgtcaaagccttttacctggccgcgaagctgaaagccgttgagtaaaaacaccgtgacgaacgtattgtcttttcggatttgattcaaaaactgatcttgaatattaatcggtttcatgtttcgtcctccttggttctcaatacaatactgtttcgattaaatttccagttttcctgctatgcactcgaaaatttccttttttttctgctcaatatcaacaggcggcgtcatatctgtccatgaaacgggcattttattgcgaaaccaggtcagctggcgtttcgcatatcgccttgaattttgttttaattgctccacggcctgaggaagcggcacttttccatcaagatattcatacagctctttatagccgatcgcctgaatcgattggctgtcccggatattcatatcatacagccgctttacttcgtcaagaaggccggtttccagcatcaggtcaacgcgctcgttaatccggccgtacagtacttctctgtccattgtaagaccgataagaaccgcattgtaaagcagctcccgtttttgggttttaagatgctctgacattgtttttcccgatacatgcaggatttcgagcgcgcggatgactcttcgcgtattgttttgatgaatggctgccgccgcttccgggtcggctgccgcaagcttggcatgaagcgcttccgccccttcttcagccgccagtttctccattcgctcccggaatacagggtcgccggagttttccgtgaacgtatagtcatacagcacggactgaatgtacagacccgtccccccgacaatcatcggcagctttcctctaccggcaatctcggtgatttttcccctcaccattttctgataatccgccgttgaaaaagtgtcggacggctccaaaatatcaatcaggtgatgcggcacgccttctgtctcttcttcggtgactttggccgttccgatgtccatccctttatatacctgcatggaatctccgctgatgatttccgcattcagcattttcgcgagtccgatgcttagttttgtttttccgactgccgtcggtccgacgagtatgacgacaggctgttttttatttttcaatatgtatcactctcttttataaatctccccctaattatagcattcatttcttcaggcacctatccattttgccctttttcctgagcgctaaacgtccgctaccacccgatcggctcgtttccgacaacctctctcgtttttcctttgagcgtatggcggtgcgttttccgtccttcctcccgcggatcgtaaacgacgccgccatgctggatccgaatcggctcattgtaggcggcaaaggtggtctctgaaagctcatggtaatgtgttccgtcaaccctcgggatggcagggccggaaatgccgtaatacctatgaaaatggccgttttcaaacgaggtgatgcccgtatagaaatgtgtatgctcatctgtattgctgccgttctccggctgcgaaaagccttcgatcatatggtagtgcccctgcactacatccgtaacagcccggtatgcgtgtgtgtgcggaggtttttttgaccaatcggactgatacaggcccacaaaagctcactcctttatttttttgataaatgcccaatcaaaaattggtgggctgaatactctgttatcatctcaaatttattcttggaggtacctaaattatgaatgaagaatacacatatgcagcagatagtgatatgagaccgtttggacggcccggatttgggtttggacggccgggcttcgggttcgggcggcccggattcggcttcggcttcgggcggccgggttttggatttggccggccttggtttggttatggattcggacggccgtttggtttttacggcggaccgttcttcggagggcttgtcggggggcttgtcggaagcgctttattcaatccgtacctgtacggaggttacggctacccttactatccgtattactactaagacaatcaaaaagggctcctttcaggggcctttttatataggcctaatgtcttgacttggcgggcaaagttcggatattattttattttactgccttaaacaaaaggcataaggattatgatgagagggggatttgatatgattctgggttatatcttcctcacaattgctattttatcagagtcaatcggcgcggccatgctgaaggtctcccgcggatttacgcggtttttgccgagcgcgcttgtagtggcaggctattcattggccttttatatgctttcacttacactgaatctcattccgctcagcttatcctatgcaacatggagcggagcgggaacggtgctcgcatccattatcggagcgaaatggtttcatgaaaaactggacaagcaggccgtcatcggacttgtattcttattggccggtgtcattctgatgaattggtagaaaggagaagcatgatatgaaaggattactctgcctggcattagccattgtatcagaagtgttcggaagcacgatgctgaagctgtcggacggttttacgcacttatggcccgctctcggcgtcattgccggaatcggagcctcttttatgtttttgagcttctctttgaaaagccttgatttatccgccgcatacgcgacatggtcaggtgtcggcacggctttaacggcaattgtcggcttttttgtttttaaggaagccatgacagctaaaatgatgatcgggcttatttttgtcatcacgggcgtcatcctgctgaaccgttccaagtctcaaaaagctaaaaaaaatcaaacggcccggagctgaccgtttgaactcgtcaagcgcgggcagcttttacttcaacctcaagctccatctccacgtttccttggaccgctcgtgaaatcatacatgaggactccgctttttgcgctaacttcctggcgagcgtaaagtccgtttcggctgcatccggctttaataatataaacgggcggtgaatgattttctggtacgtgaacacaccgttcgtgacgtctacaattccttcagattccatatgtagatcttctttatccaggccgcttctttccatcatcgccgcaagcgttataatataacaggtcgcggccgctccaagcagcatttcatcaggatttgtgccttctccgggtccgtccatttccttaggaatggacacagcggtttccagccggccgcttttaatatcgccgacgtcattgcgatttccgggccaatttgcttttaaataaaagtgatgttttgccaagggacaaacctccttttttttcagtttactcacctttcactggtttgtctttttttaagctcacgaatactcttgattgatcactctttttatcgtacggacaaaccggtaaaattcctccgtttttgtgaattccctttcgcggtaatcaaaattatcaaaaaacgcctcccgctgttctctgctgatctcaagctgtatactcagcccggtttgcgcctggttattgatattttcggtgtcaaccccggccagaccggtttttgaggttgccaattctgtaggaaatccgtttcgtttgagagctctcaccaattttttcgcccgcttccggtcgcttcctccgacaagagtatttttctcgtcgcctttataaccgtgaactgcgataacataatggtgctgcttaatgctttcgactgctgaaggctcatcgaacttggtgctcgtaatatgaagagtctggttatcatgcgcttttaatccctcaaacaggtaggttgaataatcatccctgaaagagcggacgatctcgctcaccccgccctcaattctccctccgtgcggggacatgatcaatacggggctcccctttctcttattgtacgatatatgataatcatcggggtcttcatgttcagccagatctttaaaatctgtgtatgtatcagaagaattcgagggatcagggtctgacgcataatgagcacatcttattagtaagaccattgctacgataatgatgacattaagtaaaattcttttcatcagctctccttctttgctcctttctgaaaaatgaaatattcattatatggatttttgtcaataggtcttatcttaacattctattaacattatcatcagtgaaaaacttcccggtttcgaaaaatcaatggattgtcacggttcaagcgctcaaatgccgggcatcagtgaaaaaaggttgagagagggcaaaaaaaaagggaggaacgcccgaattttcaggggcgggagattcacggccggaaacggacggcatcaagaatacgcttttagaaatgaatatccgcctcccgaagcaaatgcgcaggacagaatggagcccgtcaaaaaagttctcatctgcctttttgtacagcaaaatgccattacagcccgctcatcccctttttttatcataatggtccgttttgaaacggagccgtctctttattcatatatataatatcaatcggaagctgtttttccaaggaatgtctcaatatgatgttcatgtatatactaccttccgccggcttcattacaaaacgaacaaacgttccgtttcaactcgatttcttctcctgaaaaagccgcaagtaaccagcgctcctgaaggacaaacaaactgaccgaacttacggcctgttcatatggtatagagagaatcgccagaatgggaggaaaagtatatatgtttggttactcaatggtacaaatggtgcggtcaaatgctcataagctggactggccgctcagagaaaacgtattacagttatataaacctttcaaatggacaccttgctttttacacaattttttcgaaaaaaaggtgaaaaacagaaagaaaatgtcagtcatcattgaatttgaagagggctgccatgaatccggttttcacagcacaggacaggtcttatcaaaagaaaaacgctgcaccataaaaaagcagtttcaaacaatcaattgctgcagcgccgaagtcacgccgtccgcccttcacatgcttctttcgcaatgccgggatatccgtaaaatctatttaaaccgtgaagtaaaagctctccttgatacagcagctgaatcgtctcatgcaaaagaagtgacccgtaacggcaccgtattaacaggaaaaggcgtaaccgtcgccgttattgataccggaatctatcagcatcctgatttagaaggcaggattatcggctttgcggactttgtcaaccaaaagacagaaccgtatgatgacaacggacacggcacccattgcgccggtgatatcgcaagcagcggcgcttcatcttcgggtaaatatcaggggccggcgccggaagccgatctgatcggagtcaaggttttaaacaaatcaggatcaggaaccttggctgatatcattgaaggtgtggaatggtgcatacaatataataaagaacacacaaagaatccgatcagaatcatcagcatgtcgctgggcggagatgcgctcaaatatgataaagaaacggacgacccgctcgtcaaggccgttgaagaggcatggaatgaaggaatcgtcgtctgcgtcgccgcgggcaactccggtccggaagctcaaacgatttcaagccccggtgtcagcgagaaggtcatcacggtaggcgcctatgatgacaatgatacagccagcaatgaggacgatacggtcgcttctttctcaagccgcggcccgacggtgtacggaaaagagaagcctgacattcttgcgcccggggtcgatatcgtatctcttcgttctccgcgttcatatcttgacaaattacagaaatcaaaccgagtaggctccttgtatttcagtctgtcgggcacgtccatggccactccgatctgtgcgggcatcgctgccttaatccttcagcaaaacccgcagctttcgcctgacgaagtgaaaacattgatcagacaaagtccggatcaatggacaaatgaagatccgaacatttacggagcgggcgcagtgaacgccgaaaacgccgtgccgaaagagtaacctttttatcatgagaacggggtcgtctgcaccggcagatgactccgtttttcaggtgaatagatgaaacatttataatgaaggaactcggaacaggtcagaaccggctgtcagaaaaaaagatcaacgcaaggcagtgtatttctaaaaaaatagggaataagtatggtgtagataaaaggaggaatcacaatggcacttacaaacaccgaattgtctgaatggctgcaaaaacagatcggacaaacgcttgatatcagaaaaggagagctgacagacagccgaaacgagatttctgatatggatcagatcatgcttcaccttgatgacgttctcgtccgccggacaaaccatcccgatgactatgtagcggatgaagaactcgtcttaaaagggcacggcacaacctatacggaggaaggaaatgtcccgcttccccaagatgcgtatgaaattcctctgctcggcgacattaccatccaacaggagcaagacggattaaaggtacatacagatcgggccgtgtatacaatcgggacccggaaagagcaataaaaagaaaaaacgccgtgaaacagcggcgttttttattggtttttttcttcagaatatccgtggaacatcgtgaatgcgcaaagcataatgcctaaaataatgataatcgggagccagatcacggcaaacttataatccggttcggcaaaagcgcctatgaccgccccaaagcaatacagaaccaaggcaagcgcgcgcaatacagcatctctcgtaaactgcttccgcttgtccgctttgtaaaaccttgcggtgagatcttcaaaaaaattagcgagcgttcccgttaatacggtcgtggaaatccccgctacaccaagttttctcgcggctgtcgtctgcattcccattgcgaagctgagcagcataatcagcacataaacagaaatggcgtctgcaaaaaagcaggagaacaaagcaaacagcagcaaaacagctccttcaatagctaaagcggcagttaccgcaggggccagaatgatttctttttattgcccacaagcagggccgcggcaataacgccggcaataaatccgattaacgaggttaacgatttgagtacggcaaggtgccatgagttgccgatcgccaggccgaacagaacgatgttccccgtcatattggcggtaaagatatgtcccaggcttaaataaccgatcacatccacaattcccgctgttaaacaaagaagtaaaagtgcaatatttcggtatgtagtcactgtcaatgtgatccaatcctttctcatgctgattccaacatataagtttactctttgccatttcatatgtccagccggcgtgccgctttttcaaagcataaaaaaactccggcgaaccggagaagttactgaacgataaataatactctcgtgccgtcggaatagccgctcatttgatttccaacccatgaaccggccccgcggttatccgatggggttacatatctgatatcagcccccgccccgccttctgtgcagactgccatgggccattcatcacggtcaaacccgggctttgtcggaattcctttcaatgattctttccttctgttctccgctccgccccgatcaattgtacaaatctcagaatgacctgccgaaatggcgtcttttatatgatttcccgtctccggatattttgacagcgggaaatacagcacctgatcgtatcgggatgcagcatgagcagcactgtccgaatggatgccggcgcccgtaaggccgaactgaagagagatcaccaaaagcagacttgccgcccatttcataaacgcattcattcacatcctccttaagaagttgatatgaagcgtaaatatgtatattagccggatttaacacacatgatgaaatggcaaaaaaagtttgctgttttgttgataatcaacgaaaatggcggctttacgatttgtctattgaaccggcttctttttccttatatattttagacatacttatgagccgttgtgatcagtgtcttcggcagataaaaggaggaatgccgtccggtcggcaggcaccggctgttggttatgtcttttcaaaaacatgaaggcggggaaatccagatggaaaaaacaatgtttcacccacactcacccgagtttcacgaagacccttttgcggttttaagcagattcagagagcaggaccccatacataaattcgaactgcagcgtttcggaggcacctttccggcatggctcatcacgcgttatgatgattgtatggcgtttttaaaagacggcagaattacgagagatgtaaaacgggttatgccgaaggagctgatcgcgaagctgaatgtcagcgaagatatcgattttgtctcagagcatatgctggcaaaagaccctccggatcattcacgtcttcgatctttggtgcatcagggttcactccccggatgattgagcagcttcgcaccgggatagagcagatcacagaagagctgctggatgaaatggaaacaaaagcagaccctgatatcatgaaagatttcgcggcaccgcttccgtttatcgtcatttccgagctgctcggaattccgaaagaggaccgcgccaaatttcaagtatggacaaacgcgatggtcgacacgtcagagagcggacaagatgcgaccaaccaggctctcaaagaatttaaacaatatatgaaaacactgatcgaagaaaaaagaaaacatcccgctgaagatctgacaagcaagcttatttacgctgaagaggacggccaaaagctgagtgaatcagagctgtattccatgctgtttttgttagtcgttgccgggcttgaaacaacggttaaccttctcggctccggcaccctggcgcttcttctgcacaaagaccagatggagaagataaagcgacagcccgaaaatatccagacggcggtcgaagagcttttgcgttacacctctcccgtcatcatgatggcgaatcgatgggcgattgaagatttcacctataaagatgtttctattaaaaaaggcgatatgatatttatcggcatcggttcagccaatcgggacccggaatatttcgatgatcctgatacattaaatatagcgagaacaccgaaccgtcatatctcttttggattcggcattcatttttgtctcggggctccgctcgcccggatggaagcatccattgcctttacttcgcttttaaaacggtttccgaatatagagctgaaaggcgcgcacgaggatgtaaagtggagaaaaaacgtgtttttgagagggcttgaaacattgcctgtcagattttaatatcgccccctgtttatcgggggttttttaatgtcttataaacaggaaatcaatataacagtgaatatttagtacatagtgtatttagttctattgtaaaaaaagcggccggattgctccggccgttctctattaccgttttaccaactcatttgtttcgtccagcttttttttgaaagatttaaggaaatttgcgcttatcgttcctttgtttgcgtacagtttttcgcagaatgccttaatggcgttttgcggctttggttccgacagcattgtgacatgattggaagagtggacgtccagcaggtgaaagtgtttcatctggtgttcccattctttccaatacgcatcatggtctaacggaatttgttcttcctctgctgtcagataacgttcaaaatctccgagaaacaaaccgcttttattacggaagtagtagcattgcagcgcttccggatgaggcagcggcttcatgtcatactcttccattccgtaagcgagctgcgtcttcatcatttgctccagctgcatccggatcgcttcttcggattttggcagaccgcgctttttggcaaggccgatcaattctttcaatacttcttcttcctcagcctggacggtaatgtcttctctgctgattaatgcctcttcaaggttttcaggcttaagatatgccgtaagcatcgtattgatcgtttgcagcatgactgacttaacagatggttttctctctttccatttttcactgtacggggtgtcgatcatgacggcgctttttactgtatgaccttcctcctgcaagaggcgcgcggtttcataagcaagcatcccgcccaaggaatatccgccgaggtcataagggcctttcggctgtaccgcttggatgattctcatataagaagcggccgtctcttcgattccttgcagcggctctttccctgtcaaacctcttgcctggatgccgtaaaaaggacgctgactctttttggcgaatggctggtatgcttcaacgcctcctgttccgccgtgaaaccaaaaaacaggacggcctttttctctttcattcagcttgacgagttcgggaaaattccggcccgcttcatgcggctggttcgtttttaacagcatgccgatctcctgaagagtgctgcatttctgaagagcttccagactgatgcggctgtctccgtcctcaagttttttcagcagctgaatagaggagattgaatcaaagccgtattcagtcagcggcttattttgatcaatttccgctgccttcatccccaaaatgtcagccacaatgtcagctgcgctctcgcggcggagctgagggtcctgggaaaccggcgcaagggtgatgtcttctggctgaccgccattccaatacttgtggtgttcaaaaggatatgtcggaagcggcactctttgaacagatttgccttggtggagtctgtcccacggtatatccgctcctttcacccagcaaaatgcaagcttttccagattgttttcagccaacagcgtctccgtgacgactgtaccgagagtcccttccagtaaaacgccgatatctcctgatccagtctgctgactgcctgtaaagaagcttttcattccattgctttcttcggaaaatgctctgtactctttcagtttttccagcaattcatcttgattgcgggcaacgagtgccaagcggcagttcatcgcctcacggccggtctgaagcgtataagcaatatcccgcagtgacggagtatctccagtttgcacaaaatcagccagctgacctgcggccgccttaagacgcccttcgctcttagcagaaagcacgataagctgcgggtcatgcgcagattctttgtctttatggctcggactgtactgttccaagacgacatgcgcattcatgccgccgaagccatagctgttaattgcggcccggcgcgggatcggtctgcccgtatggtcggtgagctgtgaccattcctgattgtcttcggtgaaacggaagcggcttttctgaataaccatttgctcatttgcagctgtaaatccgggaatgcccgggatggtatgatgcttcatggccatcgctacttttataagggcggccagtccggaagcgagttcgccgtgcccgatgcaaggtttcacggtgctgatataacaaggcgcgctttcctcttgatttgcagactcgccgtaacccgctttgattgcattaaactccagcgcatctgccatttcggaggcaatgccgtgcgcttcaatataagtgacggtttgcggatcaacatcggtgtcttcgtacgcttttttcatcgcggccttcattcccgccggattcggtgcgtgaagcgacatgcctttaccgccgtgagacactcctgttcctttaatgaccatgtgaatatgatcgccgtcttcaattgccgcctcaagcggtttgatgatgataacgcccgccccttcgcttctgacaaagccatcggcatctttttggaacgatttcgcccggccgtttttgcttaaatatcccatcgagtcaaaaccgataaaacctttcggcgattgcagaatattggcggcgcccacgacagcctgctcacattcgttatgatggattgattgaaccgccctgtgcaatgccaccagcgttgacgtgcaggcagcctcgtaatattcactcggtccttgtaaattcaaggcatatgatatcctgttcggaatgatggacggaatggctgttccattgttcggatcgctgttgcccgcggcaacgaaaacgcctgtcggtctgcttgataatgccttatttgtcaggcccgcatcctccattgccttccatgtatgcatcaaaagcagaaactgctccggccccatttgtgatgcctctttaggagaaattccgaaaaagagcgggtcaaattcgccgacaccgtcaataaaaccgccccatctgagactcgtgtcattctcatcgccggcgtaacggcgccagtcccagcggtccgccggaatttcggtaatacagtgatccccgtttacgatgtgtccccaaaaagactggatatccggggattgcggaaactgagctgacataccgataatcgcgattccttgcttgacatcggcgttttcacaaggcgtatgctgtttcttcggtaaagtgcgctcttctgtttccgtgaccccggcctcttctgaatgcctatgatcggcaagcaattgagaaaacttgctctcatatgctgacgcgaagtggcgggtcagctcctccgccgtcggatactcgaaaaacaatgttggattcacatcgatgtccgcctcttggccgatctcttttgtcagcccgatcagactcgctgaatcaagtcccaattccatgatattcgcgtcagaacgaagagatgacgcgggttcatccatcatcttggcgagcttgccaaggacgtagctgcggatatcatctgtcagactgccggcagaaatcggtgctcccgcattcttaacagccgttcgggccggctgattcatctgttcggttttcgggcggaaccgtttcagggcatagccttcaaaacgcatcaccacttccgatcggctgctgatgacatctgcgttaatcagaatcatttcccccgtttgtttagccagcttgatgtgcagccagcaatcggtaagattttccgggctgctgaaggtgacggaattaatgccgaacggcagatagctttccgtctctgtttggtccaataaagaaagcgaggccaagtaagcactgttggcgattaatggatttatggcataatgatgcgcttgttgtgagtcgctattgttcaggttcactttcgctaaaacggcatcagtgcctttgtacagacgggtgatcgttttaaattcttctccccacacgacggttcccgttccatctccgtataactcatctatccggcccacttcccggtaagagcgctgaatggccgccagatctgcgtgctgcttttgaaacggatacgggctgcactcggcatacgccgctatgctccaatcaggagacgtgcggctgcggtgcattatgctcagttcaaatccatccccgttttgtttcgattctgttttcagctcgatgtgatcgcctttttttacggtaatggggctgacgtaattcagttttttaatatgtcctccttccgcttcaggaaaaaggtcacaaaaatgatcgactgccagactgttatatgtagcgccgacgagtaccggttctccgccgaattgatgccctttcacgtatgggtcgtcatcactgtataccgcctgaacgccggcagcgttttctgattcaccgaaatgaaaagaagtcccgtggtcaaaagcgtaggccggcagatgaacggcgtgctcttgctgcaactgatcaaacgtgatattctctcctttttcccattgccgcgcacgccggccgatatcagaatcggagaaattgagattccgctgatccatgcggtaagcggccagtttttccagcagttcctgaacggaagcagccgtaaatgccgcccgatactccggatgatgcgttcttttttgcagcgcagatgcgatggcggccggatgaagagatggcgtcttttctaaaaaggccgccagtctctcaagataggcttcaaaactccattttgttttcgctgacacagggaaaatatattcctcatcgccgtgacgggcctgatcggaattcgggctgatatattcttctacgatgagatttgcatatgccccgcctgccccgaaggaattgatcatgcttctccgcggtacgatgtctcccgtctcggcatccttcagacgctcccaatactcggttttctcctgcaggtaaaaggccgtttgttcaagcgcgatattcggattttgcggttttgcgttaatggtcggaactaatgtttcccgctccatttgcagcagcactttcgcgagctgggacatcccggaggccgcctctaaatggccgagatttgacttgacggatccaagcgcgcaaaatcgttttttatcggtatattgcgagaacgcgttcgtcagggcaatgacctcaatcggatctcccaatacagagccgtttgccgctgattcaacataactgattgtttccggattgattccggctttgtcaatggaagccgccatgagcttcgcctgctgtttcggatccggagccgtgtacatctgccttccgccgctatggcacaacgcgctgcttttaatgaccccgtaaatatggtctttgtcggcaaccgctttggagagcggcttcaagagcaccgcaccgactccttctcccggcatcagccccgtgccggttccgaagcttttgctttcacttccctgttcaagcaaattcgcccgttcgagcgcatcatatttagacggttcaagcgtgagattgacccccccggcaatcgccatggaacagctgttaagcttcaggctttcacaggcgagatgaatggcgctcagtgagctggagcatgcggtcgtaacgcccatgctcgggcccgttaaattgaaaaagtgggaaatgcggttggcgatatgccaatcccctccgttagagctgagcgcagctttttccaatgacgggatattccagaaatattgattgtacatactgcccataaatacaccgattccgctgtctgattcctgccattcgtttactctctctaacgagtagccgccgttttcaaatgtttcccatacggtttcaaggcttagacggagctcaggtgtcatctccatcacatggtcttcccggatgtcaaacaagtgatggtcaaaagcgtcaatatgctgcagaaatccgccgtaccgtgttttgcgttcttcttttcgtgtttcttttgccatcgttttcagaagaccggacttccatctgttttccggagcttccgtaatacagctgtctccggcttttaaatgctcccacagctcatcgagggtttcagactcgggatagcggccgctgatgccgataatggcaatgtcgtcacgatctgagcgattatcggtgacggtttctgtttccggctttggcgcttttggctctttttgttcagtgataaatcgccgcgtttccgtgacaagcggcaccggttcattcattgcaggttccggatgctccgtttcaggaggcgcttgatcggctccgaatgcctgttgcagcttatccgggtaagtttccagcaaatactcggcaagttctttcgtattcgtgtgttcaaataagaccgttttcggcagctcgcccgtcaatgtttccagttcacggataaaattcacctgcaaaatggagtcgatgccgtatttttcaaagctggtttccggctgaatgcgctcgggagcaagctttatggacttggctaacgtttcttttatgaattgcaccgtccggtctgtgactgagaaagacggttctgtgaaatcagccggctctttggaagccgcaatttcttcaaccgccggcgcgtccggctgcttttgcctgatgacgccgtcgctttctgctgccacgatctgctggccgaggtgatgtgacgattccgccataaatgtaacgtaccgatatccctcgctttccagcgcagactgccacgcttcaggatacagcccagggcatccgggaatacgcagtttggcgtcttcatacagccaccagccttccaaaagaccgaatgtcagatgagaataaaccgaatggctgctgatctcatttaatagcaaaatcccattctttttaagcaccgctttggcattgcgaagtgtccgccgaatattttttgtcgcgtgaagcacatttgccgcaattaccgcgtcatatgcacccgcctctataccctgcaaagccgggggctcttccacattaaaccgcttataagtcaaatacggattgtcgggaccgtattctttttcagcatgcatgaaaaaggcctttgacagatcggtgtagcaatattctttcacatgatgtttgacctcttttaatcttttgaaaacggccgcgctcgtcccgcccgtccccgctccgatctctaatatccggatttccgcgttcgggtcttctttcaggcgttcttcaatgaaagccgtcaatgtgtcagcgagcacctcattaaagtagtctgccgtttcattgtttttatagattccttcaaccaattccattgaggaatcaggaaacagaacatcagtggcagaaactctgccggataaaatatccggcaaagctctgagagcggtctccactaaggtgatcatcgcccgtttgctgctgtccttgagtaaaggagctttcttttcatcccattcttgccacagaacgtccgcacgctctatcggacccgttaacacatacgtactgccagactgtttcaaaaagcctttttgcaccaagatggagatgctttcttccagccacctgccgtaaaacccctgcataacaggctgcgtttcgttttccgtaaaaaatccgacagatttcagctggcctgccaatagtttgtaaagaagatcttcagtgttttgcaaagccgtcccctccttaactcaattgttgtacatgtcttgttactttaggctgatagcttcgcagtttttgcatcgccgagccgtgatgttcagggtatacttctatcatttcttccggtttttcctccggctcttccgcctgtttcatcatgacgaactgattcaatgggccgccgagcaatcgttcaagcgccgccattgcttccggcgcttcaattgatccgactcccgcctgtttcatccgttcttgatattcggcagatgatacgattccgacactgccccagtagctccaattcatcactgccgccgaatacggccgaacttgagccaaatgagcggcaaaggcatctttgaaactgcacccggcagcataattgctttgtccggccgctcgcgcaaatgattgaacggatgagaagaacaaagcaaagtccagcggctcattttggaacacgagggccatattcacgctgacattgacttttgcagcgagcacgcttctcaaacggctttccggcatattcgccaggctctgatcctctaaaacaattgcggaatggatgattccgttaatttgcgggtgcgtgcgtttgatcgtttcatacgcccgtgtgagctcatccgggtttgccgcgtcagcttcaatataaatcggcgccggcccgaattggctgagtctgtcgattttttcctggatggcgctgttatgttttcgtctgccgatccaaacgactcgcgcctgatacgttttcacggcatattcgctccatgcttcgccgatgccccccgcgccgccaatgacgacataaacgccgcctttttggtaagcgggccggcttgacaccggctgctgtacagggatgaggcgctgtttgtaccagtgattgttgcggtacgcccatgtattgccttgctcatcaaacggcgctgagaacagctccgcctttgaaacatcttccggacatccggcatcaatcagccgtgtttgccagttcggatactcttttgcgagcgaaccgatcaaaccgtgaatgcctgcatgagccggatcaatgatgtccgccggctgtacggactgtgtttttattgtgactgcagtcaagctgattcgcttgcttccgtatcctaaagcaagcatcgctttaatcactctgtacatctggatgacgcccgcatcttgagctttcaccatgtcaccatcgctgtgaaaaggagcgatccatacgatatgcccgaaagaccctcttgctttcagttcagccgcaacagcctctatttcatcctccgggttgatatgaagccgtttcgcagaaggatgatgcaattgaaaagcctcgctttcctcatcccctgcgataaagacaacctcttccgtcttatatgccgggctttggtcacggaattccgcaagatcccataccggagccagaaggtttgctccatttaatgatgtttccggcgccggtccttccatcattctggaagaaatccctttaatcctgacacagacgcggcctgtctcatcgcataagtcaatgtccagccgctgtattttttcatccgttccccgggagctgacatacgcccacatgctggtcgtgcacgggctgaaaatgtccagttcctcaagggcgaacggcagtgacagctggttatcatctgcatgcagcttcagtccgattgtcgcttgcagagctgaatcaagcatacacgggtgaagaacgtattgatctgctgtttcttcgaggaaggaaggcagacggagctcagctaatgcttgattgcttccgatatgaatgtgctgaattccttgttgtccgggaccgtagtcaatgccgattttgttgaataagccgtaacactgttcagaagtcagcatgctgaggccgcattgagctttcagtgcgcctatatcacggtgcggagcctccccggcgccgagaatgccggcagccccctgacagtgtatctgcctgccgcttgcttctgtttgtgaatccgtgtaaatgtcatacacgatttcaccgtttcccctcgggttcaggctgatttgcgcttcaatcgggcggttttccgcttcgatcggccgaacccaaacgatgtttttcagacggatgacagacggaacttccttttgccctttgactgcctgagcaaccgccgccctggccatttccaagtaggcgacgcccggcatgaccggcttgcctttaataagatgatcggtgaaaatcgtctcttgtcccgtaaattcggatcggtaccgctgctctgttaaatccgatacattctcgtgtagcagcgggtgcagcacccgcgccgtcggcacagcttgcggtttttctgctttcggccggttgtccgtgatccagtaccgctctttcgcaaacgggtaagcaggaagactcatccgttggggcttgatatcagaatataagccgtcccatttgatatccgcgccctgcacccataattccgcaagcttgtcattctcccggcggcttatcagctcttcgatatccgcttcgccgtttgcgcctgccataatggatttcagcgggattttacccgcttttcctttataaatgcccgctttgtcataacgtcctttcgcacagctctttagcttgtcccgcagttcttcggccgaggaagcgataatggccgctctttcttccatcgcatcacgcccctgctgaagcgtgtaagcaacatcggcaagatccgcatccgtaaaagaagcttgcgccagctgctgcgcctgttcctgcagacgttcttcttctttggccgacagcacaaagatttgagggtgtgtgaaaacagctgtttttctttcttccttcgggatatattcttcaatgacgacatgggcgtttacgccgccgatgccgaaagaactgattcccgcacggcgcggcagatgattgccgttttcgtctttcaatgctgtccattctcttttttcctgtacgatgtaaaacggactgtctttcagtttgatatacgggttgatgacctcgctgtggaggctttttgcaagtgttttatgcttcatctgcatcagcactttgatcacacccgcgacaccggctgccagtgacaggtggccgatattggtttttgccgatcccaaaccgcagtgactcgcgtaaacggcgggatcgcctgttttttcgtacagcttttgaaaggcggatttcaggccgttgatttcgaccggatcgccaagctccgttccggttccgtgcgcttctatataagtgacggttctcggatcaatgcccgctttgtcataagccgttctgacgacttccgcctgggctttcggattcggtgtcgtcaaggagttcgcacgtccgccgtggttgaccgcgctgcctttaatgacgccgtaaatatgatcgcctgatttttccgcttctgacagctttttcaaaaacagaattccggcaccttcactgacggcaaatccgtccgccctgtcggagaacgttttgcatttcccttctttgctcagcgcacccgctttatcataagcgatgtggccttgcggtgtgacgacggtattcacgccgccggcgatcgccatctcgcagttcccgttttcaatggcgcatacggcgtgatgaatcgcgaccagcgagctggaacaagccgtgtcgatcggttcactcggcccgtgcagattgagcatatagctgacgcggttcggccctgctgacggactcatatttgcggctgacgcaccgccgatatccaggtcggaaaacagtgagccgtacccggtatttcccgtgccgatatacaggcctgttttcgtgccggaaaggcttttagtggaatatcccgcatcttctatcgccttccacgcatacatcattaacaagcgctgctggggatccatctgttcggcttccagcggtgaaattccgaagaacagcggatcaaattccgcaactccgtcaataaatccgccccactttacatttgttttgttggcttcgttaagcgggtcaccgtaatactcctgccagtcccagcgatccgccggcacctctgttatacaatcttttccctcttctaaattgcgccaatactcatcaatatttgcggccttcggaaacactccgctcatgccgacaatggcgatcggttccggtttatgttcagccgcagtctgaacatgctgtacggctgtttttgcaaatcgtttgttccctgccagtctgatgccgccatcatctgttacaccgcttttcttttcttctttcggctgtgtgctgccggcaaattgcgtttgatagtcttctgctaaatgatgcgccaaggcttgaatcgtcgcatattcaaaaaatacggtcggtgtcagatcaagctgataagtgtcattcagcttgttggcgaattccgtcagcgtaatggaatcaaatccgtattgattgaactccaattcgatatcgatttcttcaatgtttattttcagaagcccggaaacttcttttgccagcaattcctgaagtttggccgtcaggtctttcggcgcaggtgtttcttccgttttcttaatcggtgcaaaagcggatgcgggagtcttttgaagcagtttttcccgcattacggcgcggtttccttctataacgagcacgcttgttttccccgtgctccatgctttgtaaagagcttctattccggtttcagtgcgcatcggcgttacaccggttcttttttcggtgagcttcgccatttcttcattgacttgcattccgccgtctttccaaagcggccaattgattgacaatgtgtgaccgtggcggtacattgccgtaaccagcgcgttgcggtatgccgcatagctgtccataaatgcgtttgccgccgcataatccgcctgtcccgcattcccggtgacaccggaaatggatgagaaaacgatgaaaaagtccagcgctaaatgctcggttgcttcatcaaggttgacaaatccgtccgttttaggagccaatacactgtaaaactcttcggttgttttctttacgatatattgatctttcatcacacccgcgctatgaatgatgccgtgaaggccgccatattccgtttcaattgttttgaccaggtctgccgcagttagagcgtttgttacgtcagcctgtttgtattccgcttttgctccgagtgattcaagcgatttcagctgcatccgctgattctcgcttaatgcggaacggcctgtcaaaaccagcgtcggctctttgactttccgggcgatttctttcgcgaaaataaagccgaggccccggctcctccggtaatgagataaatccctccgtcgttccacggaatgcgtattttgccgccggacacggccgtttctttgacatctgcgctgtatcggatgccgtttttatatttgatatggctgtcatcagcccttgttttattttctctgatgatgtctgtgattctgccgttttccgctggttctatttcaatcagctgggttttcagttttttatgttccaggccggctgtttttagcagagctgaaatccctgagagcagctgatgcttatctgttttagagagaaccgtctggataaggacgtctccttccgtctcttccttcagcagtttttgcagcgtctccaatatccgtcctgtataatcacggaagcgcgccgccgctttcccgtgcagggaggtcatttcaatacattcagctcccgcggcttcaaccgcttgttttagtccggcgtctgtgtcacaaagcattacgatatgccgggcaaaaaccggttccgtttgagcagcagtttcatcgcttcgtgtccataccggctcaagcatgagcgtttccggagctttttcttttttctcaggttctttttcagccgttctgaatgacaaacctttcagccttacgcaaaccttgccattttcatcacaaatatcaagatcgcgtttttcaacatgtccggctttgtggtcttcagaaagtctggcgtaaacccacatctcggcagcgcatgcgctgaatacttcaagctcctgaaccgcaaacggaagcatcagttgttcatcatttgttccggttaatatgcttgatgcctgcaatgcagagtccattaagcccggatgcatgacatactcctgtaccgtgtccgcacaagccgcatcaagagacagtctgcccaatacgaaatcatcacctgtataaatcgctttgacaccccggaaagccgggccgtaatcaaaaccgattttgcggtacatatcgtacacttcatctgcagaaaacggtgtctcggcggattgtgatctcagtttttggagatcaatgaccggagcctttgcgtcagggcggactgatactgccccttggctgtaaacggacggctgatctgtttcccggccgcagtaaatgtcgaattgaacgtcatttgccgtttcgggaatgagacggatgttgacatgaaccggctcgtcttcaatggtaatcggccgcacccaaaccgtattcttaagctggacgcttccttgtccggccggaacttcagatgcctgttccattgctgcgcgcgccatttcaagatgtgccacacccggtaaaatcggcacgccttttacaacatgatccgcaaggtaaaattcttctcctgtatagattgagctgaaccgctgttctgcaaggtttgaagtatttctgtgcagaagcggatgaagcgcgtcttgttttccggcagatacagtgcttgttttttcgtgttttccggtgtgtttcgccgcccaatagcggtcttttgcaaaaggatacgacggcaggctcatgcgtttaggcggccggtctccatacagcttcgcccaatcgacgttcagccctttgacccataattcaagcagcttcgcgtatttgccgcgtgccatccatttttcaacggcttcttgaatttcttcatcttccgtcagcatttgcagcgtgcctttgtctattcttcctctgtacaaatccgcatgcttatctccagtgataaactgtgacagtttttcctgcagttcttctgcggatccggcaataaccgccaggcgttcttccatggcgtcccttccgatttggagagtatatgccatagaaacgaggctggaatgatcgtaccgtttttcagtaagcgcacgtttcagctgttttgcctgctctttcaggcgtttttcatttttggcggacagaacgaaaagacatgggtcgatatgagaatcatctgcttcctctctgtcttctggaatgtattcttcgatgacgacgtgggcatttacgcctccgatgccgaatgagctgatgcccgcgcggcgcggctgttcgtttccgcgttcgtccgtctgcgtcttccattccatcgtctcccgcaccagataaaacgggctgtcttcaagctgaatatacggatttaccgtctcacagtggagacttttgactaatgtgcgatgcttcatctgcagcaaaattttaataatgcccgctgctcccgcggcaagggataaatggccgatattcgttttgaccgaccctaagccgcaatagccggccgctttctcttttccgtctgcaaacgagctgaacgcttgtttcaggccgttaatttcaacgggatcccccaattctgttccggtgccgtgcgcttcgatataagagactgttttcggatcaatgcccgcttttttatatgcggctttaataacttccgcctgttgtttcgggttaggcgttgttaaagatgccgcacggccgccgtgattcaccgcgcttcctttaatgacgccgtaaatatggtccccatccgcctcagcggctttcagctttttgaggaaaaagagcccggctccttcaccatgggcaaaaccgtcagcctgatcggagaacgtcttgcatcttccttctttactcagcgcgcccgctttgtcaaagctgatatacacatccggaagaacaatcgtattgattcctcccgccaaagccatgtcgcacgtcccttcttcaattgaagaaacggcatggtgtatggcaacgagtgagcttgagcaggcggtatcaatcggctcgctcggcccgtgcagattgagcgtatagctgacacggttcggtccgacagacggacttgtattcgccgcggatgacccttcaatcgccgcatcggcattggctaaaagagaaccgtagccggtgtttccggtcccgataaacacacctgtctttgtgcctgagagactctttgacgcatatccggcatcttcaatcgctttccacgcatacgtcagcaagaggcgctgctgagggtccatttgctccgcttcccgcggtgaaatcccgaaaaacaacggatcaaattcagcaattccgtcaataaacccgccttggttgacgtttgttttattggcttcttttgcgggatccccgtaatagtcccgccagtcccagcggtctttcggaatctcggtcatgcagtctttgccttctttcaggttctgccagaaagcttcaatgtcttctgccatcgggaaaatcccgctgatgcctacgattgcgatcggttccggcccttggtcccgctgcactgtctgcggaagtgtctcaggcagagtgcggcgtcgcttaacggccgggcgcgtaatttgagtctcttttaccggtcttgccgattgaatcgtttttgtatttaccgcaaaccgtccggcaaattcctcttcgtattcactgattaaatgaacggcaaattcatggattgtcggatgatcaaagaaaatcgtcggcgttaacgtaagccggtacgttttgtttaactggttcgtaaactcagtcatcgagatagaatccagcccgtattttgtcatttcttcatgaggatcaattttgtcaatgtttacttttaacagcgaggccgtctgctgttttaacagatgcttcactttttcaagcaggctgtcagcatcaatgtcatgacgtacgccgatctctgcttccggatgatcattctctttgcggaaccgttttgctttcatgtgtttcacatctccttcaaaaaccgtcatccgggctgtcccgctcatcaagccttgatataaagccttgatgccggcatctgtgctgagcggtgcgattcccgcctgctgcatcagcatatcttccgtctgctttcctgcctgcattccgccttctttccataacggccagctgacagaaagcgtctttccgtatctttgtcctgcggcttgtaaagaacggcggtactcggcatacatctccataaaaacatttgcagacgcataatcagcctggccgacgcttccaagcacacctgataaggatgagaagacaataaagacatctaatttctcatgttgtgacgcttcatcaagatacacaaggcccttcactttcggagcgagaacgtgttggaattcctctgccgtcttcttcaccatgtagttgtcttttataatgccggcactgtgaacaatcccgtccagcttgccgtgccgtttacggatattgcggatcaatcggtatacttctgcttcgtccgtgacatcggtctgctcgtagaaaacagaagcgccggcagcacgtactgtttccagcatgtctttctgcttttctccgagagcggaccggccggttagtatgatgacggcgtcttttgtacggtttgcgatctcttttgcaaaaatcagacctaaacctccggcacctcctgtaatgagataaacgccttcgtctttccacggaatgtccggctccgcttgagaaatatccatctcttcccaatcagcggcaatgcgcttgccgttttcatatttcacatggacgctttcggcatgcatacggttttccgccgctttttccgcgatgccttcagcactttctttctcctcgacttcgatcatttgacagatcagcttggaatgttcaagacatgcggttttgaagaggccggtaatgcctgagaacacctgctgtaagcctgctgaccgcgtaacagcctgaaaaagaacgcggcccttcggcttgcttttcattatggttttgatatggccaaacagctgacccgcataagaatgataccgctctgcaatagatgcgggacgatcgtccaggataatgacgcgtgcatgttcaagctttgcttcgacagcttgtttaacggcttcatcgtactcacaaaggaaaatgatatgctcttcatacgaaggcgcatgatcggccggtgccgtctgctctttccagaccggttcagcgaacaatgtgtccgtacggctgaccgaaacgccggcacccgcgttttcttccatgatccgcgttgagaaacctctcatccgcacacaaagccagccgttattgtcatataaatcaatatctgctttttggataggatcgccggctttattgttcgcactgaatgtgacgtgcacccacatatcatcagcgcacggattcagaacgtccagctcctctaaagcaaacggcaatgcggctttgaatggttccccgctttctgccagcagcgctctcgtcacgttttgcaaatattcggcggcctgaagcgcaccgtccatcatactcggatgaaggatataatcagctttcgtatgggagagggattcaggaagcttcaatttagcaagcagccggtcttcgcctttgtatacaagctggacacctttatagccaggcccgtaatcagctccgatcattcctttgtaaaacgcttgagattcgattgttccctgcgtgcaccggcgcttcagctgctcaatatccgccgcttcctccggttccttccggatgatttcagcgatgccctgattataaagaggagcttcttcaccgatagaatcgttaccgccgtacattctgtattgaatctgtccgtccccttcttcataaagtccgatatggacacggacagcgtcctgatcgactatcaccgggcggacccatacgatattctttaagcgcaggccgagagaatcctctgttgccccgccgatgcttttctccgccgcggcccgtgccatctcaagggtgacggcagccggcacgatcgccattcctttaatgatatgctcggcaataaaatactcttttcccgtaaattccgaactgaaccgctgctcctgcaagacggatgtattctgatgtaccagcggatgcaaaaacttcgcatctgtttgcttcacagtttcttccggccagaagcgctcctctgcgaacgggtaggtcggcgcactgattcttcgcggcgcggaatcctgatacaataagccccaatcaacacgcgctccttcaatccagagcgccgcaagtgctttcagcttttcatcacgtgtctgacatgccgcaagctcttccatctcctgagccgacacttctctgcttctcactttttcgccccgtaagatgttttggtcattgccgttgatgaaatcctgcagctgacgcttcagatcgtgacgatcatgactgataaaaacggctctctcttccatcgcttcacgtccggtctgatacgtaaatgccagatcatgcaaggaaacatcgttttcggcttcatccagaaagccggataaacaagttgcataggcagtaagacgttgcttatttctcgctgacagcggaacgatataaggcggctgtccgtcatttgatccgctgatcgttttgttttcatactgttcaaaaatggcgtgtgcgtttgttcctccgagtccgaatgagcttaacgctgcccggtgcggcgtctctctctccggaagcgattttctcttatccgccacataaaacggcgaaccgctgaatttgatattcggattcggtgacgtgtaattaatggtaggcgccagctcccgatgatataaactcatggcgactttgatgcacccggccagacccgctgctgtatccaaatgcccgatattcgtttttacggagccgattccgcaatactgctcccggtccgtgtaacgtttatacacttgctgcagcgcggacatttcaatcggatcacccaatgtcgttcctgtgccgtgcgcttcgatataggaaatcgtctccgggtgaatattcgtgctgtctaaaacatgctggatgacgtcagtctgaccttttacactcggtgcgtaaaaaccgactttatccgctccgtcattgttcagaccgatgcctctgagcatggcgtatatgtgatctccgtcctgaacggcttgcgacgcctttttcagcagaatgacggcagctccttctccgcccgccataccgtcggctgaagcgtcaaatgccttgacatgcccgtcgcttgaaaaattcaatccgttttggtgcacatagccgatgcttgtcgctgcatgcagcgttgctccgccgacgagcgcgtattccgattctccgctcgtgatgcttttataggctgaataaagaccgactaatgatgatgagcaattggaatgaacgaaatagcttggcccttttaatccgagcttatgggaaaccatcgtcggaatcgtgccgctctgcgctaacacccatgagacatagccgtcaggagattcatggccttctgtcgttttttccggtaaaagcgaccgatacgaattattgcttgccgacatatatacgcttgtcttcggaatctctttggatacatatcccgcgtcctcgacggctttccaagaatgtagcagcagaagccgaagctgaggatccataaattctgcgtctttcggagaaatgtgaaagaactcagggtcaaagagatcttttccttctatcgtcgataatgccggcacatagtcgggattttcgatcaaatcttcaggtacgccggcttcccgaagttcttcttccgagtagaaccggacgctttcctttccttctcttaactgcttccaaaactcatgatgatttttcgcgccggggaactggcaggaaatccccactatcgccacactgtcgtcaaagtaagacggcaccccgttttgcggtgtttgttctctttctctctcatcttggcctgatgcctctgattcagccgcctgtttagtttcaacaataaatcggctgatcgcctgaatggtagagtgttcgaataaatccgtgacggtaaaatcgcattccagctcctgtttaatgcgttctgccgccgcaacagccaaaagcgagtcgcctcccacatcgaaaaagccgtcttcggttttgatgcccgccgtattcagcaggtcttcccatattgcggtcactttcgcttccgcttctgataacggcagtctgcccgtcttttcagaccggtgaacaattaccttgcgctgttttaggtctttgcggttcacttttccgctcggtgttaacggcagcgcatccagacggataaaatgggcaggcgccatataatccggcagactcgataaaagatggttgcggagcgctttttcatctgccgtatgaccggagcgggccgtataataagcaatcagctttttatgtccgttcttttcctgaacaacaaccgcctgatcaagaatgtccggatgttcgttcaatttcgtttcaatcgctcccaattcgatgcggaagccgcgaattttcacctgactgtcaatccggccagcatattctatatttccgtcaggcagccatctggccaaatcacctgtcttgtaaagcttttctccttcactaaacggattatcaataaatgatgccgccgtcagctcaggctgattgtaatagcctctggccagaccggcgccggccacgcaaagctcgccggccacaccgtcagggacggggctgagcttttcatcgacaatataaagccgtgtattttgaatcggtttcccgatcggcgtattcctgcttgtgatttccttttggccgcagctgtagtaagcggcataaatagatgtttccgtcgggccgtatatgttttcaattctggcatgtttgaagatggaaacggccttttttactaaatctttcggaaatgcctcaccggccaccatcacatatttcacagggccgtcttctgtaaatgccgtatgccgctttaccgtttccagaaatacattaaacacggcgggagcaaaattcagatgcgtgacctggtgggtttggatgtattccatacaaagctgcgggtttttttctgcaccaggcggcaaaatgacaagccgtccgtttccgataaaccagccgaataattcagaaatcgaaacgtcaaatacgtaattcgtttttaacaaataggcatcctcttgcgcgaccggatactcagcttccaaaaactgcagcgtattcatgatggccctgtgctcaaccatgacgcctttcggttttcccgtgcttccggacgtatatagaatataagcgagatgatgcggttttgaacgcggcgtcagttttgccccgctgacagaacgtccgctcttttcaatttccaccgtgctcacaccgccgacggccaactgttcaatcatgccgcgcgtatttgcttgcgttaatacgattgaaacgccgctgtcagtcaacacgtgcgccatccgttcgtttggaaaagccgggtccagcggcacatacgcgcctcccgcttttaaaatggcgaggatgccgatgaccatctcaaaagaacgctccgtacaaatgccgaccgggcattccggtgtgacgcccttttcttgcaggtacacggcgagcgccgtgcttcgttcatctaattcgcgatatgtaagactgttttcaccgtatgtgacggcttctctgtcagggtggcgtccggctttttccgcaaacacttcatgaatgcagcgctcattcggctgatgagatcggcttgcttcacgtttttgattgagcaggccggaacaggcttcaaaagcgatctccggatcagaaagcaccttttctgccagtttcatataatgctccgccatccgttcgatgaaagaagggctgtagacatccgggttgtacagaaattgcaggacggttcccgtttcttttttatagacttcaagcgcaagctcaaattcgccttcctgatgaatgtcttctatcatttcaatgccgagtgattgatatagttccgccagcttttccgctccttctgtccggaagaagttttgatagaaaaacgcggtttgaaaaacaggcgaaaccgcaggcgagcgttccgtcttcaattctttgacaagcgcgggaaacggatacgcggcatggtccagcccttctgccagtgtcagctgcagctccttcaaaaacgccgtaaaggatttggcgcccgtctccctgcttctgaccgcgatcatattaataaagtatccgatgacagattcaaattgagcctcagagcgccccatcgtcggcatgccgacgatgacatcttcctgattcgtatattgatagagcagccctttgaaaatagcgagatacacaacggattcattgacattatgtttttgggcgcacactttaatctgccggttcagttcatcaggaagcaagcgctgatacgcctgccctttgcaagtttgaaccgatgatctcggataatccgacggaagctcaagcaccggcagcggtccttccagctgctttttccaataagagagatgcgtttttcccgcttcgctttccagcagctctttttcccatttcacaaagtcatgataatctgcggcctgctgaaccatgacaggttctttgccttcacttgcttttacataagcgtccagcagcgccgacataaacgtcataagagagacgccgtcaaaaataatatggtgaatggtgattaacacaatcggctcccgcttcgcccgccggaatacatgaacacgcaggagcggcccggtttcaagcgcgaacggttcttttgctttttctttaataaacgaaagagcgtcacgcccgcttaattcagaaagatccatttcttcaatcggaaaatgccgatccgtatcttctatctgatacggaaggccgttttcctcttttatcacactggtcaaaatagggtgctggcgctgcacggacaaaagggcgtttttgaatgtctcgatatccagcttttgaaaacgaaagcataacggaatgttatatgcgctcatctccggaaacattttctgaagcatccacaaacctttctggccttcagaaagcggacgttttgcagttgtccgcttgaaagcctgaagcttttgttctacttcagcgatggtgagcgttcctgatctgtaggcatcgagaagttctttatgattcataagtcttactcccttctatgatgtcttgcactcttttaaaatctaatgtcccctcagagacctgtttcatcatggcgatgatctcctgatccgtgtactccttgttacccggagcggcggcttttgtttcagtttcttccgttcggtaaaacgttttgatcgtttctttgtgttctgtcaggtaatagctgatgacgtctccgagcgtggcatagctgtaaaataaagccggagtgacttcaatgccgtaatgactcgacaaaagagcggcaaatttggctaaatagatggaatcaaatccgaattccgcccagtttttatgcaggacgagtttatctttagatattttcagcagactgtgtatcagctctttcaaatccgcttcgagccgtttttccgtgctttcttccgggatgcggcggctcacggtttccaaaagcgcatccggttttgatgaatcgtcccgccgtatgcctaaaaatcgttcggcgcggcttcttttgccggcaatgacaaggcactgggtgttgtcttgagaaatgatgcgctcaaacagctcaatgccttcatctgtttctaacaggcgctgtccgcttgattgcaggtacatgcccgtcgtctcttcaccgccgacggccattccgccgtttttccagaccggccagtttatgacaaaagcgtttccgctttcggattgttcgtttttatagcgggcatacgccatttggaacctgttcgcgaccgcgtaatcacagcatccaaaatctcctaaaacagcagatgtggatgaaaagtagcagatgaaatcaggcgtttcgtttttcagccactcgtcaagaagcaggctcccgtttattttcggttcaagcgtactgcggaaattcctgatttcattttcaaagacggatgttctgctttcgatgcccgccgcatgaatgacgccgtgaatagctccgaatcgttctttcgcgcgcttgatgcagtcgcccattccgatcggatcacaaacatcggcttcggcgtaaagaacacccgcgccgagattttccaggtctttcattttttctttcttttcttcattgatcggcgaccgccccgtgagaatgacatttgcctggtagttccgggcgagatggcgggcaaataagtagccgagccctcctaatccgcctgtaatgagatatgttccgccggttctgatcctgccgttttctttcgttagtccggttggttcggtgtgatagacatatcgttttccctcttccaagaaaacggtatggtctgtttcagctttcagctcgtcccaaatggttctcatccagtccgttatggccgcgccggcttttcggaagtggccggtaacacttgttttcggaagaacaatgccgagcgaacgctcaaagccgatccatgattccaagtagcacctttccagaccggatgcatattcccccgccaataacagcctttccggctgcagaccggtctcagccattgctttgagaatatggacaatacatgaataatcttcgatgcagcttttatcttcaagcgcccataaatacaaaatggcagaagcttcaccgtactctttttgaatatccgcaaaagcgttcacatatgattgcggatcttcccgcaccacttggcagcggccggcggacaaggcctcataccggtctccctgagcgataaaaataacgtcaatgtcactgtcatacgatttgatcacagagacggcttcctgctgcttcttctgatcagttaagaaagaaatcaccgttttgacttgcttttctccggcagccggcagagcctgttctttaagaacttctctaaaagccattacttcaaactgctccgccggatcactttcatcagccggcgccttaacgggcgcggccttgctttgtacaggctgctgatgccagaagcgttctttcgcaaacggataagcaggcaggctgatgcgggccggaggacggtctccgtataatttcgcccaattgatgtccaatccttttacccaaagctcaagcagcttagaatatttccgtttgctgatccaagcgtctatgatggtttccatgtcatcatcggccgcaaatacggcaagcatccgtttgttttcttccgtgccgtcacggtgcagtccggcgctgttttgtccggcgataaatccgttcagtttttcctcaagttcatgaagtgaatggacgataaaaccgagacgctcttccatcggcacccggccagtctggagagtaaaggctatgctcataagatcgcggccgctgtatcttttttcacggatggcgtctctgagctgttttgctttttcagtgagccgttcgctgtttttcgcggacaggacgatgatggcgggctgatctgccggcgtctcatcaggctctttgtctgccgtatattcttctatgatgaggtgggcgtttgctcctcccgcgccgaagctgcttaaccccgcccttctcggaagctctttgccgccgatgacgggacgtttccactcaccgagctcctgctgaacggcaaacggcgtatacgcgaaatcaatatttgggttcagctgttccgcgtgcagggacggcgcaatttggcggtctttgagctggaataatatttttgtcagacccgcaatgcccgctgcgctttcgcaatggccgatatttgattttgctgagccgatggcgcaaaactgtttgtctgttgtatcctcatcaaatgctttcgttaatccggcgatttcaatcggatcccctaatgcggtccccgtgccgtgggcttcaatataactgacggtgcgcgccgggacgtttgccctttcgaaagcttcttttattaaggcggcctgcgcattcggattcggaacggtgtatccgttcgttttgcctccgctgttaatggcgcttcctttaatcacaccgtaaatgtgatcgttgtcggcaatcgcttgctccaacggctttaatacgaccgcgcccaccccttctccgtctacaaaaccgtccgcgcggtctccgaacgatttgcacgtgtcgcttgcggaaagcatgttcatgactgacagattcatataatgaatcgggtcggtcactatgtttacgcccccggcaatcgcgcattcgcttgaaccgctgtatatgctctcaagcgccagatgaatggctgtcaaagaagaggagcaggctgtatcaacggcaatgctcggcccttggaaatcaaaaaggtaagataccctgttggcaatggaccagtagccgtagcctgtcgggtagtttttgttcatcgcgccggcaaaaacaccaatttttctgctttggcacaggttgtcaggcgtatagccggcatcctcgatactcgcatacgccgtttctagaaataatcgctcctgcgggtccattcgctccgcttccaaaggagaaatctgaaagaacagcggatcaaacttgtccatatcctcaatgaagccgccccatttcgtataaatagagccttctttacctttctcttcatcgtagtaatcctgccagttccagcgttcctgcggaatttcttctatgcagttttttccttttttaatattggcccaaagctcagccgctgtttttgcctgcgggtagcgtcctgaaacaccgatgatggccacgtcgcgaaccgaactttgccggacggtctctctggctgcccgcttttccctccgccgccagtcagtgcgaagcggcttggccggctgtacagcctgcggttctggtgatgccttccgttcttcctgaacaggcgtttgtcccgtcagtttgatcatcgcgtcttttttcgttttgattaagtgagcgacgagcgcttcgatcgtctgatattcaaaaaataaagtgctgctgacttggtccaatacatttcgtaacgcgtttgtcagctgtacgacgacgatagaatcaattccgtatttttcaagcggcgctttcggatcaatttgagccggcggaatttttaacgtttctccgattaacgttttcaagtactcggtgcttttttctgttaaagacgtgtcgcctttttgcaccgttgtttgcggcgctttaaattccggcgcttgtgctgcttttggcggagcggtccgttttccggcccctgctttaagcgttttttggcggacaacgccgttgctttttgccgctataatctgatggcttaattcatgtgccgcttctgccgggaagaagacagaatgccagccttcactttctaacacgcgcttccagctttccggatacaagcccgggcaccccggaatacgaagggcagaatcttcatgcagccaccagccttcaagcagtccgaaagtaatatgcgggaacaggctgtttcccgccatttcatttaagagcagcaaaccgttgtcttttaagacggctttagcgtttctcagcgtctggcggatgtctttcgtcgcgtggagcacattggcggcaacgacgatgtcgtatgcgcccggctctatgtcctggccggcaagcggcgcttctgcgttaaaaagcttatacgtcagataaggattccgtttgccgtattccgtctccgcatgcacgagaaaagctttcgatacatcggtgtaacagtattcttttatatggttttgatacggcctaagcttttcaaatatgcctgcgcttgtgccgcctgtgcccgctccgatttccagtatgcggatctcggcttttgaatgtttgctgatgttttctttcacataagccgttaatgtttctgacagggcgctgttaaagtaatccgcgacttgattgtgcttataaattccttcaacaagttccattgaagagtgcgggaacatgatgtcagtcgccggcacgtcttcgcgcagaatgtccggcagtgctttaagcatcgtctcggctaaaacagtcatcgcttttgtatcggcgttattgagccattcctctttttcctgctcccatttttgccatagcgaggcggttgtgtcttcggcacgggccgacagtttatatgaatccgcattcccttccagataaccatgttccagaaggaaagcgatcgtttgattgagccattttttaaaatattcgtgttcgggctcatacgctttaaggctttgcggcgtcagcaagtctgcttctttaagctgggcgatcaaaagccgatacagaaaatcatcgagcttttgatgttcagcctcttttacaagacgtgcgccgggcggagcggccttcagctgttgtgaagagacaagcggctgagacggataaacggaaattttttctgtttcactcatcccttcgactgcgaccggttttgtcgtatgaatgaaagctgcttgatcaaccggcagcgtcataagggtttcaagcgcctccatcgcagcgtccggttcgatcaatcccaatccgatctgatccatcagctgaataaaatcgccgtcttcagccgcttcgctgttgccccaatagccccaattcatgactttgaccggacaattccacgtctgatcaagttctttcgcaaatgcgtcactgaaagcgcatcctgcggcatagtggctttgtttcacgttatggataaatgccacaagcgaggagaagaagagcgcaaagtcaagcggctcccgtccaaatacctccgccatggacacactgacatcggcttttgcccgcagcaccgatttgaactcttctgtcttcatattatttaagctttgctcagacagatccattgccgagtggatgattccgttcatttttgtgtgacgctcttttatgaactgataagcccgctctaaggaagcactgtcagcggcatcggcggaaacatattcaggcgccgggccgaatgcgctgagccggtcgagtttcgcctgtatggaatcattcagtgtgcttcttccgatccaaatgatatgtgctttgtagcggcggatcatgtattcactccatgcctcgccaagatatccggcgcctccgatcacggcataaaccccgcctgtttggtacagcgtgccgtttttcggcatattgtcaagcggtatcagctgccgctcaaacagctgctgattgcggtacgcccaaatttgaccgttttttccggcagaaagactgagcgcctctttgaccggccagctgccgtccgtttccgtgtcaatcatgcggatattccaatgcggatattctttcgccattgttccggcaagtccgctgactgcggcctgtgacggggcggcgctgtcttgatcggaaaacggctgggcatttgctgtgacgatgcaccagtccaaatgtttttctccgtaccccaaggcaagtaatgctttcatcagcttgaacacatgaagaacgtttctttcctgttccttgaggctgcaagcactctcagcctgcggagcaagccaaatgatttgctccagctctttttgtccttcaagcatgtacgtaagagatgtgatatcatccgtacctctgatcggataataggaagcgttcggcagatgttcttttatgcgcgtatgcgttctgtcagtttcaccgaaaaccgcagtctgcttttccgctgtttttgctttcttcgttttttcaagtgcaacgggctcccatgccggaatcagcatcgtatggccgacaggcgcttccggggtttctccgcccgctgtttggcctgtgtcaagcgcccggacggacgcgcctttcatccggacataaaccgtaccggcatcatcgcacatatcaatgtcaaattttcttacgttgtcatctgctttgctgccttctgtgtaccggatatatgaccagatatgttcaggacacggcccgaacacttccacttcctgcatcgcaaacggcagagaaagctcgtggctgtctgcatcgtcatgtattgagcggacaagcagaccgacggaggcgtgaaaagcggcgtccatcatactcgggtgaagcgtatactgttctttattgtcatgtacggcagccgggagtgaaatacgggccaataatcggtcttctccgatcagcaattgctgtacgcctctgtatgcctctccgtaatccagaccgatcttctcaaaagcaccgtaacattcttccgcagtcacggtccctgaattgcaggaagctttgacagactcgatatcaatctgggcgctttccggttcggtaatgaccgcttcaccctggctgtgaataaccggatcttcgccgttttctgcctcactgtatatttcataggtaatctcaccattatcttctgggtaaagggcaatatgtatttccttcggtttgtcttcaatcatgaccggccggacccaaacaacctgcctgagtgtgacgctatggtctttttccgtcacggcagcagcctttttaaccgcctctctggccatttccaaataggcaacgcccggcagtattttttgtccgttgacgacatggtcagataggaaaaattcatctccagtaaaaagagacgtgaagcgctgctgcgaaaaatctgacgtgttttcttgtaaaagcggatgcagcactgtgcctgacgggcttttctcctgttttttctgctgcggaatccaatagcgttcttttgcaaacggatacgtcggaacgcttgttttacgcggtttacccgaagcgtacagcctattccaatctattattttcccttctgcccataactcggcaagccgtatcggatcatccgtctcgggagcggtttcgctcagttccggcagctcggcttgtccgcgccaaagaccggggatgttttcgtttccttttacgaaatcattcagcttttctttcaagtcgcggatgtcatttacaaggaagacagctctctcttccattgcttcacgtcctgtctgaagtgtataagccagttcagacagcaccgtcttttctgaaagcgatcgggctagtttttccgcataggccagaagcctgtctttatttcttgctgacagcgggatgagttttgctgcattgttctcaggtgcaggcgctttttgttcaggctgaatgtattcttctaaaatgatatgggcgttcgaacctgatgcaccgaaggaactgagtccggcccggcgcggataatgtgtgacttttccgttttcttcggctgccggctgcttccacggagcagtctgctgctgtacgtaaaaaggagatccctcaaatttcaggtaaggatttaattccgcagaatgcagtgatttgacaagcgttttgtgatgaagctgcagcgccgcttttgttaacccgctgatccccgccgctgattctgcgtgaccgatatttgatttgaccgaaccgatggaacaaaattgctgatcctgcgtcccttggctgaacgcttttgacagaccttcaatttcaatcgggtctcctaacgaagtacccgtgccatgggcttccacataactgacggtccgcgggctgatacctgcttttttcagacaggccttaatgacttctgcctgtgcagcaggactcgggacggtaattccgcttactttcccgacgtggttaacggcgcttcctttaatgaccgcgtaaatgcggtcgccgtcttgttcggctttttccagcggcttgagcaagaccgcaccgactccttctccggaaacgtagccgtccccgccctcgccgaatgtgcggcagcggccgtcacttgagtgcatccctacgcttccgtagctgagatatttcgccgggtgcagcgacaagttcacccctcccgcaagcgcggcttcacattcgccgcggcggatgctttcaatggccagatgaacggcggtcaatgatgaggaacaaacggtatccaccgcgatgctcggcccgtggaagtcacaataataggacactctgttggcgatctgcgcataattcagtgaaaccggaaaaggatcagcttcagataattgttctgcgccgattaaggaataatctttatgcatcacccctgcaaatacgccgatcggatgctgtttctcccctttattccccagcgtttcaggcgtataccccgcatcttcaatcgtttcccagcatgtttctaaaaacaggcgctcctgcggatccatcgtttccgcctcacgcggtgagattctgaaaaactgcggatcgaaacagtcggcatcgtcaatgaaaccgccccattttgatactgtttttccagacggggacgttacgttttgatatgttttccaatcccatcgggacttcggaacttcagtgatgcaatcggtgcctgccttaaggttttcccaaaactccgccacacttttcgctttcggatagcggccggccattccgataatcgcgatgtctccggtgtttttatgatgttctggcgcgtccggcgcttcagcttcagatcgtgatgattcggctgcacgttcctccgcatattcaaatgaaccagtctttttcagaaaggctgcgagttcttttatatttgtatattcaaagagaagagtgggcgcgaggtcagcacccgtctttttactgatatcctgtacaatctcaagcaaagaagatgaattcagtccaagctcgtagtagcctgcaagaacgtccagcgtctcccaaggttgcccaagcttatcagccaaaagcttctttaaaaacagaatgatgtctttttcatctgcgctttccggctcagctgcagcctgttgattctgttcggctgtattcgcgtcttcgagccgaaccgcttttcccgtaatgtttttaagctccgccaccttttgtccggatcggctgaagtactcgatcgtcatcgttgtgagttctttttcctgacggacgccggaagcggcgatacgcgccgtgcactctgattgaagcctgtcagcggccgtgaacgattcataatataaaggcaggtgaagccggtttgtttctgaaagcaaaccgctccccccgattccgctcgcatccaaaagggccggatggaataaaaagaaatcttttccttcttcgcaagaaagctcagccagcatgccgctttctgtttcgtacaattgtccatttgatttcatcatgccggaatgaaccaagtcatgatccagacagcggttatacatatcatcaagattcagagacctggctgactgcttcacatcgctgaaatcaatgatttcgtcaaatgtgacagcgtctcttttcaccatttcagccgtcgcatattgtatattgtctgacagctcgtcaccttgctgtttctgccctgaaagggagatgagccactttccatctccgctatcagaacattgaatggtcagaatgattgcagccgtttcactgacggttaaaggctgataaatcgtaacgtgcttcaattcaagctcattgtatacataaccgtgttcctgaaaaacctgataaatcaaatcgatataagcaagaccgggcaataccgcttcaccaaagaccatatggcccttcatgatgggatgatccagtgagatattgattttttccgatatcattccttcccactcctctcttatttaaatgctttccaaaacatttttttcgcaggaagctcttgtttctccgctcgtacgtcaggttcttttaccagagccttacgtcttaatgacggtaccggcagcggctttcttttcattcgggtatctttttcttcccaagcttccagaatgacgtgggcgttcgttccgccgtcggcaaagcagttgatggctgctgacggtctggctgcatcccattcgccggctgttttatgaaagtgaaaatctgtctttgttatatcaaaatgcggcatcggttcgtctcctgagagaaacggaaccgtttgtttatgcttcagcattaatacgactttaatgaagcttgcaatgccttctgcgcaaagcggatgcccgatgttcggcttgattgacccgatgccgagcggaacatgctgacctgagcggtatacggattgaatcgccttcagctcaagcaaatcagtcaccgcggaacccgatccgtttgcttcgatataagtgatgtcttccggctttttgccgcttttgagaagcgcgctttgcataacgtctttttgcgcctgcatattcggggctgacgggcctgccgttctgccgtcattgttcatggcggcagccttaatgaccgcgtgtatcgtatcgccgtctttttgcgcctggcttactgtttttaacagcaccatgccgacgccttcaccgaggaccactccgcctgaacgcttgtcaaatacgtgaaatgccggtttctcgtttaacagcccgcgctcttggaacatccggtgcgccgcatccgtgttcagcaggctgacgccgccaactaccgccgctttgatatcgccgcttctcagtgcctgaacggccatgttcattcctgtcaaagctgatgaacaagccgtatcaagcacgatactcggcccgcgcagatcaaaaaattgcgaaacgtttgccgctaaataattctgcccgcccgcaacaatcgggttgcgggtattcgcaagactttcaggatcaggctgatgctggctgcggcctccgatatacacaccggcttctatgcccttgatttcttcacgggtatagccggcatggcaccaaagtttcaagctctcttccagcaccgccaacgcctgagggtccatcgctttcgcgtcgttttccggaatgaaaaagaattcggaatcaaagtgatccatattgtcaatcaatcccgcaacatattgatttgcatatccgaaacgttccgccgggacggagccgattgcggacctgccgcttctcagcaagtcccaatattgttctaacgattccgctcccggaaaacggcagctcattccgacgacggcaatgtcttcagttacagcagcacgcttttgctcagtgtgaaccgtttgtacggcagccggaaccaacatttccgtatcaggttcctccctttctgcaagcagcggctgcccattggatacaagccattcggcaaacgcgtcaatcgtcggatgttcatataaaacagacggatctaagtcctctttgagcgcttgattcatttgctgtaaaagctgcgctaaaatgatcgaatcaaccccgtaatcctgaaacggttcgtctgtttccagatcttccggagcgattttcagctcatcggaaaacagtttcacaagccatgccttcgtatcaagaagcagttctctgtctgaatgtttttccgcgtctttgccgtttattacggcttcagtctctttttgttttttctcttgacagagcagcctgtcgggatgccattcgctccgatcaacgatagccggcagaacggacgggcggatgttttcagataaaatgcggtccagcaagtcaagtccttccgcgttggacagtcccagcagcccggtctgcttcaggttttctgtgcggatttcacccaatccggtttccttccagttcggccattgaatgctgactaacggatattgatgctgatgagccgccgcgaaataatccatgtacgcatttgccatcgcataatccgactgtcccgccgcgagtgccggaacgactgcagatactgaagaaaataagacaaaaaattgcaaaggatcatttgtgaaaaggctgcttaatgtttgaagcccggcgactttcggttcaagcacttcttgtatgtcgtcggcagtctttctgataaacgccggatttactgaattaaccgatcccgcacagtgaatgacgccgccgatcggtcccatcgtgcgccggatcgtttcaatttccgctgccgccgcgtcatgatcagacaatttcagactgatcaccgccacttgcactccttttgcttcaagctcttcaatcgcccgtatcttctctctcagcctcatattaacggctgtccgtttatgacggggaggaatcggctccctgcctgtcagcactacttttttcacgccgtgtttttctgtgaaatggcgggcgcataagagacccagtcccctcgtccctccggtaatgaaaagcacatggtcttcaggaaacggtgctggcttatgttctgctcgcttcccgcttggaatctcgctgaacaaagcacggtatctttgtccgtttcggcggcagacttccggttctgtgctgtccgccgaaaattcatctgcaatctgtttggcaagcgtctgctgatccgtatctgtatcggtatccatgtgtctggacgtcacgttttgatactcattttgaagcattctgtacaggccgctttttgccgctcctgcaagatgaatcgttttctgctgaaatggctccaagccttttgttacatatagcagcgtcagcggccgcgcttgccggcggcttgtatcaatcagagtctggagccggctgatcccttccagtgaagggtcttcgtctccgcatcccgtcagatcgattacgccatctatgtgattccaatcgctagctgcagtgtcagcggccgggagaatgaacgagtcagcgaaatgcttcgcagtctcttcggcaagttccgctgttcttgcatcagccagaatcatgaccgtcctgccgcttttctcaccggccgaatcgatctcacacggaacccattgcttttctaaaagcacagccttgcgccggtcttctgtttcctgcggtacggctttcggctcaggcagccagtacggctccttcgcaaatgggtaagccggcagactgattctgcggggtttttcgccttgatagagtctgtcccagtccgtctgaagccctttggcccacaattccgctattttggcgtattttttcttatcgaaccacgacctgacaagctgcttcagatcatcgtccgtttcaaatgctttgatttctttttttgccgttttgatgtgggcttcatatatcccttcacccgtatttccgtttacaaaatcggttaaacggctgatcagttcttctctcgaaccggctgtaaccgcaagacggtaatccatcgcatcacgcccggtctgaagcgtgtatgccatatccgaaagattgatattctgattggcttttgcaaattcgatcacagactcagcataggtttttacctgcggcgcttttttcgccgacagcacaaaaatgtttgtctcatcagacttgcggcttccccggtctttcggctgatactcttcgataacgagatgagcgtttgtgccgctgtagccgaatgagctgacgcaggcccgccgcggtgctccgcctgtttcccaaggtttaagttcggtattgacaaataaaggcgagtcatcgaaatcaaaatgttcattcggcgtgctgaaatgaagggtcggcacaagctgctggtgcttcatcgacagcagaaccttctgtacgcttgctacacctgccgccgccgacgtatgcccgatattcgatttaaccgaaccgatggcgcaaaattgtttgcggtccgttttttccttgaatacagaagataaggcttctaattcaatcggatccccctgctttgtgccggtgccgtgcatttccgcataggtgatgctctcagggtggatgttgtgcgcttcatacacttgacgctctaaatccatttggcttttcgcgcttggtgcggtaatgccgttggtttttccgtcttggttaattccagatccgataatgactccgtaaatatggtcttgatcggcttccgcatctttcagcctcttcaaaacgagcgcccccgcgccttcgccaggcacaaatccgttcgcactgttatcaaatgctttacattggccgtcaggagacagcattccggcttcacacatgctgatgtatgattcaggcgttaaatacaaggtgacgccgccgacaagggccatgtcaatttcatgattcaacagcgcctgacgcgccaaatgagtcccgacgagagatgaagagcatgccgtatcgatcggaatggccggccctttcaaattgagataataaggcaggcgggccgccgcgatgctgaaactgttgcccgtcgcgcttcctcctgtctgatgtttgtttaacatcattccgtattcattgttcataatccccaaataaacgccgcaattttttccgtttaattcttttgagctgtaacccgcatcttcaaaggctttaaaaccttcctgtaaaaatatccggtgctgcgggtccataagttccgcttcagacggagaaatattaaagaacagcggatcaaactcttcaatgccgtcaagcataccgattgatctgcagtatactttgcccttcttgtttaaggccggatcatagtatttgtttacatcccagcgggaaagcgggatgtcgcggatagcgtttttcgcacgggctaagttgtcccaatatgcctttaggtccggcgcatccgggtacttgcccgacatgccaactatggctatcgcgtccgctatctcgtctttaggctcccgtttggcctgcaccggttcaggttccttttgaaccgttaatctctccggctcggcaggtgttttctcctgcggggcggcttgctgtgtaagcggctttggacgtacgggaaccgcctgtttttttctgccgcggacggacggctgcgtacgcagaaaatcggcaaattgacggattgtcggataatcatacactttcgttacgttacagtccgtgccgtaccgtttattgacggcctttatccattcaagaccggtaatcgaatccataccgaggtcaataaaggcctcatcaatatccacttcatgccgctccatgtacaatacatcagccagtgcttttgataactcgtcatgcaccgcttcaatcggttcttccggttcggcggaagctgccgtttcagacatcgcctccagaatatccgcttctgcttgtatcacatgctgcttatgagcgtttaaaggctgcagcagtatgtttgacggtttttttacggcctctgttttctgcggttcggctgcttcctcaaggatcggttctgtcccgagttctttttgcaagaaggccgcaaactggcggattgtcggataatcatatactttcgtcaccgtaagggacgtgccgtacgctttattaacggcctttatccattcaagacctgtgattgaatccatgccgatatcaataaatgtgtcatctgcgtcgatatcgtcggcatccatatataacacgtccgccaacctttccgttaattcggcacttactttttcagcggataccgccggacgggaagcagactgtacggttcttttcggtttcgcgccgctcaaaggctgcaatgaaatgtttgacggtttttctttggcagtctcctcgtgaagagttgctacttcaatgaccggttccgggacggccgccggtgcgatcggcgcagactgtgtttcggccggtcttttgacagctgcatcagctgatgtgtcgatccaataacggtcttttgcaaacgggtaggccgggagactgattttttgcggtctgcccatttgatacagcttatcccaattcagcggaaggcccttcacccaaagctctaatacctttgcggctttgcctttttcaagccatgcctcaatggttttttccatgtcctcatcagccgcaaacagcgccatcgtgtctttattctgtttgacttgtccgcggtagagccggtcaattgactccttgccgcccgtaaattcgtcaagcttttcttcaagctcgcgcaaattgctgacaatcattccgagacgctcttccatcggttcacgtccgatttgaagcgtatatgcgatccggctcagatccgcttcttggtaacgcccgctccgcagcgcatcaagaagacgttccgcccgtttttgaagcctttgttcatttttcgcggaaaggacgatcatcgatggatgaggagcggcaaaagccgtctccttatcctcatcagcggtatattcttcgatgacgatatgagcgttgacgcccccggctccgaatgaggaaagccccgcggttctcggcagttctttatttattccgttttcatttatgaccggtcttttccactcttcaagcgtctgctgcactataaacggcgtagcgagaaaatcaatattcgggttaagcgtccgggaatgcagtgacggtgcgagcttcttatgtttcatttgcaggagcaccttcgtcagacccgcgatgcccgccgcgctttcacagtgcccgatattggattttgctgagccgatggcacaaaactgtttatcttgtgtttgttctgaaaaggcttttgtcagacccgtgatttcaatcggatcaccgagtgaagtcccggtgccgtgggcttcgatgtagctgactgccctcggatcggttcccgcgtcttttaacgcctgtttgatcaccgcggcttgggcgttcggattcggtacggaatacccgtttgtttttccatcatggtttacggccgttcctttgatcaggccgtaaatatgatcaccgtccgctttcgctttagaaagcggcttaaggagtaccgctcccactccttcaccgggcacataaccgtccccgccttcaccgaaactttcacatctgcctttgcttgataaaaatctgttctggccgagcatcaaatatttattcggatgaacggatacattgacgcccccggcaaatgctgtctcgcattccccgttccgcaagctttggcatgccagatgaatggctgttaaagaagaagagcacatcgtatccagcgccatgctcggaccgttaaaaccgaatacataggaagccctgttcgcaattgatgacggatttccggtcagcgcaagcgattttccgcgcgcctgttcttcggctccgtaaagctgatattcctcatacatgacgcctacgtaaacaccgacattggcgccaagcaaatcacccgatttttccgtgagctttttgcgcgtgtaaccggcatcttccatcgtttcgtagacacattgcaggaataaccgctcctgcgggtccatcaattttgcatcccgaggcgaaatagagaagaattgcggatcaaatttgtccacgtctttcaaaaatcctccccattttccgtacgtcttgccttctttatctttatcagcgtcgtaataaagactgtgatcccagcgatcgtttggaatttcagttatgcagtcagtgccttcactcaagttcttccaaaattcctgaagattttcggcttgcggatatcgtcctgatataccgataatcgcgatatcttcacgctccgtcactggatttttccgcgtgtctgtgcggacttgcgcaaagccttttttggcttcattccgtttggaaacgggctttatttcggctttttcagacagcgccggtttggctgcagaggtttcttctgttttcagcccggtcacttccagcagcgtgtcccggtgtgctttcataaaatactgcgccagcgattcgatattctgatattcgaaaaacaatgtttttgacaatgaaccgaagctcttttccagccggcccgtcaaatgcataatcataatcgaatcaattccgtaatcttccataggcgccttggcgtcaattttgccgacaggaagttttgttacttccgaaagcacatgtttcaagaaatgctccgttttttctgcaagcatgttctctccgcctgccgtaagacctgccggttcttccgtttcgctgcccttatccggctgatcatccgctgattttttcagaaacgcccggatttttgcggcgtagccttccgtcaccatgatttgggatgtgtttgccgcccacccgcggtacaaagcatggatgccgttttctgttttcatagggaccatgccgctttcttttgtcagcatcgcttccgtttcagcatcaaccgtcatgccgccgtctttccaaagcggccagcagattgaaagggtgtgtccatagcgttcatttcgggcttttttacggtttcttttttcactgaaggcgttcatgaacgcattggccatcgcataatcagcctggcccgcgcttccggcgcttccggctccggaagagaaaagaatcagaaaatcaagctcaatgtcctttgccgcttcatcaagatgaaccagtccggagactttcggcgccagcacatcacggatttcacctttgtgctttttcagaatataattgtcttttatcgttcccgcgctgtgtatgataccgtttaatccgccgtactgtcggcagatgtccgctgtgagcgattgaacttcttgtttttccgtcatgtccgtttgtttgtacacggcttgcgcgccgagatcggacagttcttgcagctggtcttttttacggttatccaacagagaacgccccgttaaaataagcacggcgtcttttgcatgtcgggcgatttctttggcgaataaaaatccgagtccgcccgcaccgcctgtgatcagataaacacctttatccttccacggcttttcggcgccgaactgttcaagccctgtttcctgccattgtgccgtatagcgcttgccgttttcatagcgaatatgtttgtcatcaggatgagcgctgcattcttttacatatcgggacagcgtgtctgccttgacgtccggctccaattcaatcagctggccggtcaggttcgggttttcaagcgccgctgttttcaaaagccccgttaagccgcaaaggagctgcgtatccgcttcttgaggcacgacaatctgaatgagctcgcgcccgccggaatttgaagcgagaattttcttcacttcttcgaacgcctgaagcgcacaagcttcaaaccgttcgtcttcactcttatgctgatcacggagcacgtgacagctgaagtctgtctgtatgctgttcatttgatccgtaaaccggtctgatatcatcacgtgacgggctttgaaatgagtcggcgctttttcatgtacagcggccttctcttcccatacgtgttcaaaaaatagtgtatctgttttatccgtttcaatttcccgtgcggaataaccagtcattttcacacatacattgccttgttcgtcacatacatcaatatccagcttctgcacggcatcttctggcttgctttcgccgctgtacgcaatggaaacccacatatcgcttttacagcttttcaacacatcaatctgttcgagagcaaacggcagcatcggccttatgtcatttccgtctctgtcaagcattaacccgattgtcgcgtggaaagccgcatccaaaaggctcggatggaggacaaactgatcttttgtatgagaaatagatgacgggagtgagagcttcgcgagcactttgctgtcttttgcatagatttccgtgaccgctttgtgagcatccccgtattcaatccccatctgtttgtatgcctgatagcaagcgtcaggtgtgatcagacggcgtgactctcttaatttgtcaatctcgattttggccggttcgccccctcggacaaacgccgcgcttccttgcgcatagagaacgggctcttgttccgaggaagccgattcaccgtaaaccgtgaagcccatctccccattttcttcatcataaagacggagatacagttctgcggattcatccgccgctgtaaacggacgtatccatacgacgtttttcagacggactgttccttcttccttcgtttctgccgcgtgttcaacggccgcccggaccatttccagataagccgcgcccggtaacgtccgctcgtttttgacgacgtgatctttcaggaaaaattctccgccgctaaaagaggaccggaaacgaacacctgacatgtttgatacattttcatgaaggagcggatgcagcatgcctgcccttttttgcggcagcgattctcttttctccgccttcggcacccaataccggattttttcaaacggatatgtcggcaggctgatccgattcggtttgttttcaccgtacaagagattccaatccatcgttcctccgccggtccacttttcggcaatcatctccagactcccggaagaaagccatttatgtatcaagtccggagcaagctctgcctgattgcttttatcggctcggttccgccagcatccgctgaccgttttacccgccagaaagccttccagccgctctttgagctgtgtcatattctgagcggtgaacgcaacccgctcctccatctgttcacggccgatctgaagtgtatacgccgcatcctcaagcggcaggccgggataaataaatgaagacagcttcgcaacatactcttttagccgttcttcattccgggcggaaaccgggaaaatgaaagtctgttcttctgccggttcatacgctgttctccgtgattcttcagggataaattcctccagaatgagatgcacgtttgaacctgtcgccccgaaagaactgatgcccgcacgccggggatatacggtctcgtttccgttttccgtcactgatggctgctgccatgcttcggtatgatgctggacgtaaaacggtgattgttcaaaatctaaatacggattcagctcctcggaatgaagagacggcaccaaagttttatggtgaagctgcagggcaaccttgcttaagccgctgatgcccgccgccgattccgcatggccgatattggacttcactgatccgatcgaacagaactgtttgtcctgtgtgtactggcggaacgccttgacaaggccttgaacctcaatcggatcgccgagagaagttcccgtcccgtgcgcctcaatataactgaccgtgcgcggatcgatgcccgctttgtccaggcattcttcaatcaaatcggcctgcgcgacaggactcggcacggaaattccgctcactgtccccacgtggttgacggcactgccctttatcaccgcataaatccggtctccgtcttttaccgcctctcgcagcggttttaataaaacggcaccgattccttcagccggtacatagccgtctccgtctttcccgaatgtatgacaaaccccgtctgttgaaaacatgtcccataaaccgtatgtcagatatttattcggatgcagcgacaagttgacccctccggcaaccgccgattcacattccccgcgccgaatgctttccgcagcaaggtgaaccgcagtcagcgaggatgaacagaccgtatcgacagccatgctcggcccgtgaaaattgcaaaaatatgaaactctgtttgcgatttgcgcataattaagagaaagcgggaatacatgatcttcagaagaagcttcagccccgaccaacgtataatccttatgcatcacccctgcgaagacaccgacgcgctgcctcttattccgtccgcgcgcctctgcgagcgacttcggcgtatatccggcatcctcaatcgtttcccagcatgtttgtaaaaacagccgttcctgagggtccattgtttcagcttcccgcggcgtaatccggaaaaattggggatcaaagcaatccggatcatcaataaatccgccccattttgaaatgctctttccggaaggcgactttacattttcaaaccggcgccagtcccagcgagactccggaatttcggtgacacagttttttccttctttcaggttttcccagaattcatgaatattttcggcctgcggatagcggccggccatgccgataatcgcgatatcttcatcttgcggaacactgcttttccgtcttctttctgtttgcttctcaacctgcttctctatttttgcaggagacgcgctgaaatggcttccgtactgctctgtcaggaaagccgccagctctgatgccgtcgtatattcaaacagcaaagtcggagaaagggtttcgccgattttttcactgatcgtttcgacgacgtcaagcagtccggacgatgtcagccccatttcatagtagccgacttgagaatcaatctgttcaagcggcttgccgattttttcagccatcagattcatgacataccgttctgcttcctcatgcgggtgtccgccttcaagcgatgccgcaacttccggtaaaccgactttttcaggaggcttctcagcagtctttcggtctgtattgatcagctcggcatcccgcacgagcttgcttgtgaaatctttcagctcggctacttttcggccggatgtgttaaaaaactccagtgtaatgtaaatgagctctttttcctgccgaagcgacgaacgtttgattctcgtgatgcagccggcctgcaaaggttcggaagctgtaaaagattcgtagaaaagaggcagaaacagcctcttttccccatttaacagcgaggagatcaataggtttgcgccgacgccgcttccgtcaagaagagtcggatggaacaaaaacccttcggcctgtcccatcgcgtcttttccgagcgatacatcaaaggtgacgccgtcccgctcctcaaacacttctccttccgctttcatatatccgctgtgaaccaattcctggcttctgcattgggcatacagctcatttaaatcgatggtgcgttccgcctcgcgtttgacagagtcaagatcaagcgtgtcactgaaaactgcgggtgccgtctcgtgcatttccgctttgacgtaaatacgttcttccggctggactcgtccgccgctgacctcagccccttttgcggtaagtttccagcgcccttcttttacctttgtacattcaaccgtaagcttgacggcgctgtcttctttcgcgataagcggctgatatatggataaatggcgcagctgaagcccgtcgtatgaatagccgcgctctttaaaaatctgataaaacatatcaatataagccaatcccggaaggactttttgtccgtaaacgtcatgatgtaaaataaacggatttttcagcgataaagtgatttgcttattgaagttcttcacgttaaacctccacttcataggtatcccagatgtttgccgcagctttttcgttcgtttcttctttgctgtccggcgaaatcagccgcttatttaatgcaggcggtgttaaagggtggcgcttgattcggcgcccttcgtctccctgccacgcttccacaatgacgtgggcatttgttccaccgtcggcaaagcagttaattcctgccgccggcattggtgacggccagtctgccagagtgcggctgaactgaatattggccttttctctatcaaaatgtgtgttttcatgctcacctgataaaaacgggataaagctcttttctttcagcatgagaacaacctttatgaaacttgcaattccttccgcgcaaagcgggtgcccgatgttcggtttcacagatccgattccgagcgggccggcgtcttttgaacggtagacggattgaatggccttcagttctaacagatccgtcacgaccgtgcctgaaccgttcgcttcaatatgagtaatgtcttccggctgttttccgcttttttcaagagccgtcttcatgacggatttttgcgcttccagactcggcgtagccgggcctgccgttcttccgtcattattgacggatgccgccttcactacggcataaatagaatctccgtctgcaatggcctgagacacggtttttaaaagaaccattccgacaccctcgcccagcacgactccatcggcgcgttcgtcaaatacatggaacgactgcgctttacttaatatgccgcgctgttcaaataatttatgggtttcttctgattcaaacaggctcacaccgccgacgacggccgcttttatttctcctgttacaagagcctgcacggccatattcattccgactaaagcagaagaacaagccgtatcgaggacaacactcgggccgcgcatatcaaaatattgagagagattggcggccaaataattctggcccagcgcgacgatcgggtttttcgcatccagcagtttctcttcacccggtctgtgacggctgcgtcccccgaggtacacacctattgcttctccctttatctcatccggcgtatagcccgcgtgataccacaggttaagacattcttccagagcggccaaagcttgagggtccattgcctttacatcttcttcagccagtaaaaagaagtccggatcaaattgatgaattccatcaagcattcccgcgtaataaggcgtcttcacccccatcgctcagccggaacaggaccgatagccgaacggccttcagccaaaagcgaccagtacgcctctaaggaagccgcccccggaaaccggcaggacatgccgacgaccgcgatatcttcccggtgaatctgtttttcggccgcctcttcttgcaccttaacggcttgtgttacaattaccggctcagccggcttcttcataacaggctcagccgccgccaaatcaaaccgttctgacaaaacttctgtatacccttcgagaagccattttgcgaaagattgaatcgtcggatattcatacagaatggacgggtcaagcgatgccgagagattccgattgatccgctgcagaagctgagcaaggataatggagtccactccgtaatcttggaataatacgtctgtctcaagctgatcctggtcaatccgcagctcttcagaaaataattctttcagccattcttctgttttccttgttaattgagcgttgtctgcggcggtatcagcggttttttccgccgattttaccatagccgggctcattggctgatcctgcctgctccgccgcaggaatcgctccggcttccacagcttaggattcagaacggccggcagcaccgggccccttgctgattcaagaagtatgccgtcaaggagctgtaatccttctgcattcgtgatgctgtatagcccgctctctttataagctttgttcgttacttcgcccattccggtttctttccagttcggccactgaatgcttacgatcggcagctgctctttgtatgagtctgcaaaatagtccatatacgcattggccatggcatagtcggcctgtcctgccgaaagcgccggtatcgcagctgacacagaagagaacaagacgaaaaacttcagcggctcttcgctgagcacactgtataacgcctgaagcccctctactttcggctcgagcacgcgctgtatgtcttcatcggtttttctgatgaatgcgagcgtctctttatcggtcacacccgcgcagtgaatcacgccgccgataggtccgagcgtctgtttgatctgactcaattcctgtctcagcccggcttcatcagctaacgggactgacaataccttcacttgtacacctttggactccaagtcgagaacagcttcaattttcgcttttacagaagccgtcaccccattcagtccgcccgtccactcacttcgcggcggaagggtctcacggcctgtaagcaccagttttttcactccgtaatgttcggcaaaatggcgtgcgcataaaagaccgatccctctcgtccctccggtgatcagaagcacatggtggtccggaaaatcaattctctcgccttgcgtattcatattttctgaaccgctcaatacggcgcggtagcgcaagccgtccctccggcaaacttccgcgtcatcagtacgggcatgaaactcatcggcaatctgcttcgccagtttgtcatccgaaagcgctccttcaagatcgagatgccttgaagacagatgactgtactcgcatgccagcattctgtacagcccggcccgttttgctcccgttatttgattggcctttttccccattgactcaaggtctttcgtgacacaaagcagtgttatcccttctttatgcccatgctcaatcaattgctgaagccatttgataccggtcatatctccagaagcttcttctttcgctgcaccgagaaggtcgatgactccgccaaacgcctgccagtcatattcacctgtaaggtctgatgttgtgataatacggtgattcggcatatgcgctgcgatctcttctgcgagattgatcgtgtccccgcctgtcaaaatcgcaacggaacgtgggcacggttcacgcagttcgagcgggctcggttcccattgttttgtcagaatacgtttcatccgttcctctgtatggaccttatttttgtcaggattctcaggcacccaatacgtgtcttttgcgaacggataagacggaagactgagtaaacgcggcgtacccttttcatacagccggttccaattcaacacgccgcctttcacccatacctctgccagcttggcgaattttccttttttaatccaggcgtcaatgacgatgtccatatcttcatctgccgtgaacaaggcaaacgtatctttattgcggtgagactggccggtatacagcccggcgatgtttttctcatttttcgtaaatgcttccagctttgtttccaattccgccatcgtcgctgcaagaatggccaggcgctcttccatttcgtcccttccggtttgcagcgtataagcgacgcccgccaagtcttgatctgtatacggcgtttgacggatcgctttttgcagctgctgcgcctgttcgaacagtttttcttttgatttggcggacaaaaggatgattgccggattttccgggctgtgctcaggcagagcggctgctttcgggacatactcttcaatgacgatatgggcgttgaccccgccgatgccaaatgagctgaccccggcccggcgcggaatggcatttccgtttctatctttcgctgccgtccattcctgattttcccgcacgatgtagaaaggactgtcatcgagctgaatgtacggattgatcgtctcgcaatgcaggcttttcaccagcgttttgtgcttcatttgcaaaagcactttcatgacgcctgatactcccgcggcaagctctaaatggccgatattgctcttgaccgaaccgatgccgcagcggtgatcggagacttcaggctcttgatttgttttcgccagctcgtgaaacgccgctttcaaaccgtttatttcaatcgggtcgcccaattccgttcctgtaccgtgcgcttcaatatacgtgacggtgctcgggtccactcccgctttccgatatgctttcaccaataaatcagcctgcagtttcggattcggcgaggttaacgtattcgcccggccgccgtggttttcagccgtaccgcggatcacgccgtaaatcggattgccgtcacgttctgcatctgtcagtttcttcagcatcagaattcccgcgccttctcccctgacatacccgttggcatctttggagaaggttttgcattttccgtctttgctgagcatgcctgctttgctgtagctgatatgcgcttcttccgtcagaatcgtgttgattcccccggcgatcgccatgtcgcattctccgttttctatagcggataccgcccggtgaatcgcaacaagcgagcttgaacatgccgtttcaaccggctcgctcggcccgtgaagatttaacaaatagcttaaacggttcggaccgatggaaggaatcatgctgcctgtcgccgcatgtccttccggcgcaagacctgcccttgtgaacaaatctttataaccggtatttccggtgccgataaagacacccgtatttgtgccggaaaggctttccggcttacagcccgcatcttctatcgcccgccatgcataagtcaataacagccgctgctgcggatctaaatattgggcttcccgcggtgaaatcccaaagaacagcggatcaaattcagctattccgtcgataaagccgccccacttaatattcgttttgttcctttcaagattcgggtcgccatcaaacgcttgccaatcccagcgttctttcggaatggttgtgatagaatcttttccttctttcagattgcgccaaaattcctctatatccttcgcgcccgggaatcggccgctgattccgacaatggcaaccgggttcaagcggcgcggctcttgtgtcgctgccctagcgttcatcaccgttgcgaaacgctttttccgatgcgttttcggtttttgggcttttggctgctcttttttcggagactccttcttcttttcgccgaaacggcccggatgctcttttgccaaatatccggcgagattactgatcgttccgtactcaaagaaaatcgtcggcgccagctccagctgatacgcttcatttaattgattcgtaaagacggtaaaggatacggaatcaaaaccgtattcactcagttccgtatctgtatcaatgtcctcacggtcaacttttaaaatgctgcttaccatggctgtcaaagcggtgtgaagcgcttgaagagattcttctgcatcgtgtttttcttccggctgaaaaggaagacctctctctgtttcatccgacaaatactctgctaaactgcggatcgtcccgtgctcgaagaagatcgtcggtgccagctccagctgatacgcttcatttaattgattcgtaaagacggtaaaggatacggaatcaaaaccgtattcactcagttccgtatcaatatcaatctcgtcttggccgacttttaaaattgaactgaccaatctgataagcgcaccgtgccatttgtctcccgaaacggcggatacaggttctattttctccacctgcggcttttcagtttcagaaacggacaggaacgactgttttaattttgctgcgtgtccttcagctgctaaaagctgcggcttttcctgagccattccttcataaaatgcagccaggcctgacgccttttgaagcggaaccatgccgaaagcttttttcatcattctttccgtctcgtctcccgcctgcataccgccatctttccacagcgtccagttaaaggcgatcgtttttccgtgccgcaggccattctccgtaagggattgcctgtaagcggcgtatgcatccataaacgcgttgccggcggcataatcagcctgcccgacattgccgagaacgccggaaacactggagaacaatacgaaaaagtcaaggttgcagtctttgctggcttcatctaaataagcggtgccgatcactttcggatcaagcacttcccagaactcttccttcgttttttgcagcaggaaacggtcttgtatcacgcccgctgcgtgaataattccgttaagctccccgaattccgccgtaatctcttttatcagcgcttcattttcccgccggtctgccgcattcagctttttgtagacgacatttgcgcctgagtcctgaagcatagcaagctcacgctgtttggcttctgccagatttgagcggccggtcagaatgattttcgggtgttttacgcgaccagcgatttcttttgcgaacatcaaccccaggcttcctgcgcctccggtaatcagatatacgccttcgtccttccagacggcgccgccacctgcaggatgcatttcttcccaagccttcacataccgtttttctcctgtataacggatatgtttatcatgcggccgatggctgtcgtttttcagtttttgagcggcagccggcatttcgccgattgattccatctcgatgagctgacagtcaagttttccgtattccagctcggctgtttttaacaaacctgttaaccccgcaaacaattgctggctgccgtctgctgaaataacagtctgaatcagaatgcggccctgccttttttcgctgatgatccgccggatgtgttcggcgattgtctgcgcgtagccttggaagcgttcagcggctgtttctccctcaccttctgcaatcagcagctcggcgtctttcaggccggatgccgcttcatcttttatacggcaggcatcttcacaaagtatgatcaaatgctcatcagcatggacagaagctttctcggatgcggcggcttctttccaaaccggtgcaaacaagaccttttccgagcctgatggccgctgagccgattctgcatcgccttcaagcactctcgtagagaatcctctcaccttcacgcaaagcgctcctgtttcgtcgaacaggtcaatgtcggctttctgcacggaatcaccggtttgatatccttcgctgaagcgtgcatgcgcccgcatagtcggtgtgcatggtttgatgacttcaaggtattccagcgcaaacggcagaatcagcttttgtccggaaaactcctgcataatgcagatcgtcgccgtctgaatagccgaatcaatgatgctcggatgaagcgtaaattgtccgttcgtatgagaaacagaatccggaagctgtatatccgaaagcacttctttctcgccgataaaggcggacttaatgccttggaaggcttttccgtggaacatccccctgctccggccttcccgataaaaggccgccggatcaagaatgtccgctgtgcatctgttttgtatggcagaaaggtcggcctcaggctctcgttcagcctttatgatttcagcccgtccttggctgtgcagcacttcttcatcgtcagcgtttacgctgtaaatgtcatatgagatgatgccgtcctcttcaggaaacagcgcgatatggacttggcgctcttgttcgtgaacgacgatcggtttcatccagacggtatgatggagcgttattctgtcttggtcttttaataagccgccaagcgcccgttttaccgcttcataagacatttccaaatatgccgctcccggcagcaccgctttttccctgaccacatgatccttcaggaaaaattctgagcctgtaaaccgtgagctgaaccgctgaacggccaaatctgacgtattttgctgcacaagcgggtgtaaaactgagactccggtgtgtgcggcagatgttttcttttctgcttttttcggccagtacggctcctttgcaaacgggtagaccggcacgctgatccgtttcggatgcttgtctttgtaaagcttgtgccaattaatggcgacacctttactccacatttcacagagcttcgttccttttcctttcgcaagccatttctcaatgagttcagcgctgtcatcatcatcagaaagccaggcaatatcttttgcctgctgtttttctcctctaaagcagcctgttacagccggcttatcattgataaaatcggcaagctgccgcttgagctccgcagtgccgcttgtgataaaggccgcgcgctcttccatcgcttcccttccgacttggaacgtgtaggcaagatcagcgaggccggcgtccgtttttctttccagaaaagccagcagctgttttgcgtactccttcagacgatctttttttctggcagacaacggaatgatgaacggaccggcagcgtctgctgcttcggatgcatccggatattgttcaaaaatcgcgtgtgtgtttgttccgccaagaccgaaagagcttaaagccatgcggtgcgctctgttctcacgggttaactctttcttttctcccgctacgtaaaacggagagtcttctaaatgaagattcgggttcggctctttgtaattgatgctcggcgcgatttcctgatgatataagctcatgacaaccttgatgcagcccgccattccggccgctgtatccaaatgcccgagatttgttttgactgaaccgatgccgcagtattgttttttatctgtatatcggccgtacaccgattgaagtgcggacagttcgatcgggtcgccgagttttgttcctgtgccgtgagcttcgacgtacgcgatcgtttcaggatggatgccggtctgatcaatgaccttctgaatgacctcagcctgtcctttgacgctcggcgcataaaatccgaccttatccgctccgtcgttattgacgccgattccgcgcagcagcgcataaatatggtcgccgtccttaacggcatccgacgcttttttcaagagcacggcgccggctccttcaccgccgatcattccatcagcagccgcgtcaaacgctttaatatgcccgtcgcttgaaaaattcagccccggctgatgaacatatccggcacttgattccgtatgaagggtcgcaccgccgacaagggcatacttggcttcgccggaatgcaggctttgaaaagccgaatgcaggccgattaacgaagatgagcagttggcatggacaaaatagctcggccctttcaacccgagtttatgagaaatcatcgtcggaatcgtgccgctttgggcaagcacccatgatacgtagccatccggcgtttccagctgtgctgtcgtctcctccggcagcaggctgcggtaagagttcgtgcttgcagacatatacacgcttgtttccggaatttcttttgagatatatcccgcatcctcgattgccttccatgaatggagcaaaagcattctcagctgagggtccatatattccgcatctttcggtgaaaagccgaagaaaccgggatcaaacatttctttcccctctaaaactgatttagccggaacgaagccgggatgatcagccagttcttcagaaacaccggatcggcggagctcctcttttgaaaagaagttgatgctttctttgccttctttgatgttattccaaaattcataatgatcttttgctcccggaaactcacaggatataccgataaccgcgacactgtcctcataataatcgggaatttctcccgctgggtgttcccggtcttctgtattcactttcttttgcggcacaggagccaaaacggtttctttcagtttttgttctgtgatgtaccggctgatgtcttttaccgtcgcgtattcaaacagctccgttacactgaattcacaatccagttcctgcgtcatccggtcagtgacagtcacggcaagaagcgaatctccccccgcatcaaaaaagcggtcatcaagctctatatctttgcttttcaatacatcctgccaaatcgccagcaccgcctgctggatatgagatgatgaaaatgtttgtgtgtccggctgcttttccgtcagatcgcgggcagcaagaagcttgcggtcaacttttccgttcggtgtgagcggcagctcttcaagacggataaacgaagctggcgtcatataggccggcagcgcttgtttcaaatgattgcgcaattcctttgcagacggaagcggctctccgtttttcaggatataaaatgcgcaaagtttttcatttccggagtgattgttcacaaccactacgctttcctgtacggccggataggcattcagccggctctcaatatctccgggttcaatccggtagccgcggattttgacttgggtgtccatccgtcccatgtattcaatgcggccgccgggaagaaaacgcgccatatcgcctgttttataaagctttgatcccaattcgagccggtggctgacgaaaacgttatctgtcagctcaggcttgttgaaataccctcttgccaatccgtctcccgcaatacaaagttctcccggcatcccttctaaaacagggttgagagcggaatccataatatacacacgggtattggcgatcgggcgcccgatcgtaagcgcgctctcattttccgttatacgctgcaccgcggaccagattgtcgtctctgtcggcccgaacatattccaagcctcacttttcgtatcgagaaactgctgcttcaattgttcgctaagcgcctctccgccgcaaaggattttcactttttcttcatttgaccatccggaatgaaagagcattttccacgtaaacggcgtcgcctgcatgatcgtcggtttgtactcttgaatcagctctttcagcttccgtgcgtcttttgtgaattctgtcttacagatgttgcactctgctcctttgattaaagggaggtaaagctccagtgccgcgatatcaaagcaatatgtcgtgacggcaagcagtttgtcttcggacgtaagccccggttcattcgccatcgagattaagaaattggtcagcgcccggtgcggaatcatcacgcccttcggtttgcccgtgctgcccgacgtgtaaatgacgtacgccagatcgtcaggtgtcactaaccgcttcagcgacgttctttccgcggctgtactttcaatacgagaccaatcgcggtcaatggcagttgtctgcacgcctccccagttcaaggagtgctctaaatcagctgtcgtcagacacattgaaatcctgctgtcggcgatcatatattccaatctgtcagcgggataagaaggatcaagcggcacatacgctcccccggcttttaaaatgccgagaaggccgacagccatatgcaatgaacggtctgtataaatgccgatgagatcatcagggcctgcaccgtgcgcctgcaaatagagcgccagcttcgtgcttttttcatcaagctcacggtacgtcagcttttgctgttcatacacgaccgcacaagcgtccggcgtttctgccgcctgacgttcgaataattcatggaagcaggcatccggatattcacggcttgtctcattccaagtcttaagaatcatgtgctcctctctttttgtcatgagagaaacgttctcaagcggcatatccggattcgccgtcaaagcttcagcggcctgtacaaattggctgaaaagtctggccgcccctgcttcgtcgaataattcggtgctgtatttaatcgtaagatccatgcctgatgcttcttcccacatttcaaatacaagatcatattccccctcctgatgaatgtcttttacaaactcacaggagaattccttgtattcatccagcatcgattgatagcttgaatactgcagaaagttctgatagaaaaaggcattgctgaaaacaggcgaaccgttctgcaggggtttcgcatgcacatcacgcaccattttcggaaacggataaaaggagtgatccagtccgtccagaacggcatcctgcaccttttgaacaaagtcagcaaatgtttcttttcgtccggctctgctccgtataggaagcatgttgaggaaatggccgaccactccgtcaaagcgttcttcaggtctgaccatcgcaggcatgcctgtcacaatatcttccttatctgtatatttgcttaaaagcaccatatagcagctcagcataacggtagacaaatgaatcgaacgggatgcggcaaacgccgttagattattcagcagccgttcgggaagacggcgtgtcagcgtatcttctgtaaactccggaacgctgctgcccgtgcgcatcggcggaagctgaaggtcaggcagatcgcccccgagctgtttcatccagtaagcgcgggcagctttgctttcttcacccgctaaataccgcttttcccaagccgcgaaatcggaatgaatgccgggagcggcggccgcaaactcttcttttccctccagcagcgcctgataatgatccagcagactgtgaataaatgtaatggatgaaaaaccgtcaaacacgatgtggtgaatgaccgtcaaaagataatgttccgaggcggattttgaaagcagccgcacgcgcagcaaaggcccgccttctttgacaaacggctctttaacttttttccgtatcagagcgggtatttgtgattcattgacgtcagaaatatcttcttccgagaatacaaaaggatctgccgcttctatgaaataaaacccgccgtctgtttcattcacggcgcttttgagcatcggatgctgctttaatacgagctgaaacgcctgtttcagtttctctttgtcgattccggttgtgaatcggaaacagagcgggacatggtatgcagtcgtttcaggcgacattttctgcaatgtccacagccctttttggacttctgaaagcgctggcgccgtttgccgtctctcccgttctgccggcggttcggctttttgggaatgatgctccgctgacatgtttgccgctttttcagcagtataagccgctaaagcgccaatcgtcgggtttttgtgcagctctcttgccgtcagccggatgtgatacgttttttcaattgatctggcgagtttcatcatcttgatggagttaacgccaaggctttgaaacggtgtatttggatcaacaagctcatccgcgatggaaagttcctctttcagaaaacggataaaatcccgttcaatttctttctctgcagaagccggggctgaattgccgccttcttgtctgttattatgtaatgaatcaaattgcccttgttcgaatgaatgtttcagctgagtgcgctggattttcccgattgccgtcttaggaatgtcttcttttgcgaccggaagcagataatcaggggtaacgccgattctctgtgtcacgtgctggtgaatgtgatgaataagcttcgtcatgcggttctcatccaatggaacagacgtcacaaagaaaatcgccagctcatctgtcgtgctttgattcggccggacggcgcatgccgctgtatatgacgtttcaatttccggcaattcctcaacggctgattcaatggcgtggctgtaataattcacaccgttgataatgatggcatctttcgtgcgccccgttatcgtcaggcggccttcacgcagaaatccgagatctcccgtttcaaaccagccgtcttctgtaaagacactctcgtttaagtccgggcgctcataatatccgctcgttacagtcagaccggacacttgaaagcggccgatttctccttcttccaccacttgattgcggtcatccgtaattctcatattaaaccccgggatcggcagaccgatctcgacgaaacgatcgtcgtcactcgtgttttccagtgtaaactcatctgagaaaattacgcccgaagacgtttcggacattccccatgcgggacggatggcattagccggcagaccgtgcggctctaaaagctccataattctgcgtccgactttcgccaccgcggcctccccgccgttcagcatataacgcatggaagataagtcccatttccgtgtttgaatctcttctgcgaaatcggcaagcagcccaaaggcaaaattgggggcccacgtgaccgaagcgcggtaatgatcaatcaggtcgagccattttaaaggatccatcaaaatggattcgctcggtatgttgatttcctcacatccgagataaacatcacgcagatgaagcattccgatgccgccgacatggtcaaaaggcatccagttaaacgtgacatcctcacttgtatagccctgcatctgaatatttcctttgaccatgcagacgatgttttcatggctgagcatcacggctttcggcgtgcccgtgcttcccgaggtcaaaagcagcatcgccaaatcttccggacggggatgatgacagtccgtatccatttcatgcgcactgagatcttctgccgccaaagcgcaaaacccggaaagctcctgctcctccgcccattcagtcatctccggcagcacttcacggcttgtgatgacatacggctgattcaaaagcgtccaggcgtctttcagtttttgcgtcccgctgttcatttctgtataagccggagcggccgcaagcggaaccgggatcgctcctaaaaaaacacagccccaaaacgcaggaatcagctgggaattgtcactgagctgtaatatgacttcatcctgagccttcactcctgattggcggagccctttcacaatcgaaagagcgatctttttcaggccgctgtaagtctggtacactttggtgccgtcaggctgtatatatgtgatgcccttttgatctcccgctgccgcggcggttttgtgcaggacttcaggaatcgtcatcggctgatccgctgaaagccgcaatggttttccgtagctgacagatggcttgagtaacccgcttgccttcatatcacttttcatagagctgcctccatttcatctgtatgtaagatgtatgtcttatactccgtacatcgtcgtgattcgttttttcacttcatcatcatgaaacgtctcatcgtgcatgattaactccttctcaatgacagccggaagctgctcgcgaaacggcgtcaccaagtgccttttcaatgtaattaaagagtttctcggtttttccgcaagctcacgggccaattcctgcgcatagtctaatacttcctgccgcggaagcaccggaaaaggcactcctcttttctccaggtcaccgccgcggtagtggccgccgtttaacagcatttcatggccgaggcttgccccaagcttctccggaacgataaaggtagcccccattccgggagtgaaaccgtatttcataaagtttgcggtatacacgctttctttgcttaaaatgacaaaatcactgaaaagccccatgacaaacccgcctccgattccgtggccctgcatggctgaaataacggggatatcacattccagcgccaaagaatacatgcggtcttccgtaaacttcgtgatgccctgctgaatcctgagcagaccttcctgtgtgcctccggaagcaaagtaatggccgtatcctgttaaaatcacagctttatagactgacgatttttttatacgggtgaatgcttccatcaatccatccgtcagttctttggagaaagcgtttttatgggctttatcctgcattgtcacttggataatatccggttcaatttcgagcagttcaactgcggcgttcggcatgatatcctcctaactgttctccgtttcccaaggaagccgccccgtttctgcataacggaaaatggctgattggttatccggatctgaaaacatcgcttgattttcggctagagcaatggatttcgaacgatgaacaaggtcgtttaaggaatccatgtattttttatagcggatgactgcttttttcgacagcgggcgaagacgcagcaaatgctttctcagctctgttgctgagtccgggacgcatacgtcacaaagtccccattcaagcgcctggcgtgccggcacgggctttgtcatgatcgtcatataatgagccttttgaaatccgattctttgaattaaaaacggcagaacgcaggctggataaagtccgaataacagttcagataaactgaacgaagcactctcctctgcaatgacgatatcgcaggcggcggcaaaaccgacacctcccgcatttacttttccgcggacgcgggcgattgtgatgtacggcccggattttaatgccagccacaaacggtaaagcggctcctgcgattccgcatgctgcattccctgcctcattttccggtacatctcatcaaaatccgccccgaaacaaaatacctccggctgcccttcaagcactacggaggtcacggagtcttcacattcagtaagaacgtgcaggcattcctccactaaacgctcattaatcgtattgttggcttcaggccgatcaaaggtgatgaagcagacattttgctgaaaacggacgttgatcgtctcataggtcacgggatccacctgtatttccgatgaaattccgtgatttcttccaaatataaacgagggctcccggcatgatggtctaaaatgttcggaatcatattcatatccaatttgacattccgggttccgaacttcaccagaccgctgcctttaaacagttcttcatactcttccatggacagcctgtatctgttgttcagatgctcttctattttgaaagaatgctgccgcgtttgtccttcaggcgtcacaacgccgctgtaaaattctgaacagcatccggagccgtacgagaaacagccgatccgcttagaagtgtcgaaagccccttgatcaatcgtgcttgcaagagccagtaaagaggctgcccccataatgtttccgactctttggcagtagcggagccccggctctaccctggtttgaaaatcctgttcgatctcagcgtttttcgcttttgcaagcttacgcatcatcgtccggtgagctcctttgaccatgccgccaaacggtgtatggaaggcaagatagtgaaacgtctctttatagtcagcgcccggcacacggtttttgtactcgcgaaatgtctgttcgcagcaatcgagataagacatcaatgacaagtcggcgtcaccggcttcactgtccgggatcggacggcatgtatccatcacctcatagccgtaatagccgttggcgcccgcatccgcctgaaatacgattgggttttcaccgatcaataaggcgacggcacccgctccggcgctcggttcggcgtaagaccaatcctcgcttaacgcatcgccgccttcggcaattaaaaaccgggaaatatccgtcgcgacgacaagcgccttcgctccgggggatgtctgcgacaaaataaaattaagcgccatctgcaaacccgccgttcctgaataacaggcctgcttcagttcaaataaacggcagttccggttgaggcctaaataatcatgaatatatgtactgagtgattttccgaagtcgatgccggactccgagcaggtaatcagcagctcgattctgtctttttcagcctctgtcaatcggtcgataatcggctttgccgcattaacgccgaatgtgacggggtcttcgtacggaagcgccaccgctttttctttcatcagtaaattctcaaatctggcagggtctaagtttctgtactccgccagctgcatgacatcaaggtatgccgtcccgccaaacacatttatcgcttctattccggcagccgccatgaacttcgcctccaatatgaattttgagtttccgattttttcaccgttttatcagacagcctgtaccttttcataaagctttgccgccaattcgccgatgtttgacactcccgtcagctcaacacgcgggatctgcagtgataattcttcaagcatcatcgtgataatttcggcgcggtccactgagtccgcccccagatcaactaaccggtcttcctttgaaagctgttcgccttctaaatcaggcaaaacctcgtagattgtgttctgcagcaattcaaagattctttcttcactcattgtcagttcctccctgtttcatcttttatgaatattccatgttttcaatctatcatttcgtcttgtcaacacgtttgcagaaatgagcctaacttctgattcaaaagcgaggccgtctcttccataagacgaaggccgataccatcggcatggcggtttttccaggactccagctccgtacctttcacccattgattaaaggcgcctaatgccgggccgcaatgaatctggaagtctaccttggcatccgggtctcctttaatcgccgaagcagagctttgcctgaaataccatttgaatatgagcgccattttctgtttcggattccgttcggcttttgaaatgtcttcattcgaataatgagccttcactttgtcataaatactgcttacacttgccttaaaatacttctcttctatttgtctgagtgtcttttcatcaatttcttcaattgagcggtgacgctgatacagttcatgcagcttagaggcccgggtcggaaagaacagccctttctttaatacctgcaccttgctgcctgattcaaacatatcgccggccggcgcgtaggccgtgtcctgtacattcatctgctgcaggagatcctttacgaggccgctcgtcgctgcttcaacggtgcattggttaatggatccggtcacaataaaatcagcgccgagcataaatgcggccatagcagcctcaggcgttccgattccccctgcggctccgatgcggacggttttgccgtatcggtattttttcatcatgtcatctcgtaaacggatgatcgccggcatgagactgtaagcaactccgccgtcagtgtggccgcctgaatcagcctctacgcagatgtcatgcgcaacgggtatttctctcatcagacttgcttcttcagcggtaattttgttttcggctgcaagtttctgcagaatgtgatcaggcgccgggctgagaaatgcttccgctacttccggacgggacagctttgcgataatccgctgacgcgctattatttgtccgccggcaccgcgttttaaccccttagcgcgaaaccttactaaagcaggagtaaccgttaaaaatgctgatgcttccaagttctgaaccccatgcttcagtaaaagatcaatcattttttcttctgaatctgtatgcttcatgttatgtacaacatttatgccaaaggaaccgccgtcacgaagctcatgctgaattgacaaaatggcgtcctcaacgtgcgcgatgttcaaaccgcccgttccgaaaaagcccatcattcctttttcggccagtttgacgaccatttccttcgaagaaattccgcggtacatgccgccggccaagtaggcgtatttcaattgataatcgcgcttaaactcttcatttcctaaagactccgccgtaattgagctttttccagcttcagccgggactttgatttcatctgttatcggctccgcttcagccgtaattctttgaatcagccccgtcagcacttttccgggaccgatttcctcaaagatcatgttctttcttcccattaaaaaacggatgctgtctgtccagttcaccgatcccgttatttgtccggtgagtgtctttttcagctcggtctgctcataaggtcttgccgtcacatttgaaatgaccggaatggacagcggcttaaaatggaaagtttcaataaaccgtgaaaattcctccttcgcttccagcatgtatctggaatgaaaggcgccgctgacatttaagcggtgaaccatttttacgccgtttacggcttcaaaaacggatgcggctttttcaatatcttctttatatccggaaatgacaatttgctgcggagtgttcatgttggcgatatcaatcgtatgcaagtgatactcccttaaaacgtccgtcacctgctcatgagtcaggccgatcaccgctgccatgccgcctccttttgcgcggctcatcaggtcgcccctttttttgaccagctgtaggccttcttcaaaatcaaaagcgcccgaggcgtataacgcgttatattcgcctaaactgtgtccggcggtaaaatccggtttcaagccggtttcttctgtttttttcaaataactgagggcattgacgacatagagcgccggctgagtgaattgagtctgattgagacgttctccgtcccggcacagctcctgaatggaatatccgagaatgtgatccgcctttgcggttaattcaggatagcggccgaacaggtcctctcccatccctattttttgcgagccttggcctggaaaaacaaagctgatcatcttacagtctccttccgggcggtgataaaatgctgtcttctatttgctgcaaatgggtttgttctttatgaaacggcgtcataatggcacggatgcgttcagccgatcctgcgggaagaatctgtttggcaaatgcggccaacgttccggaaggcccggcatcgatatacaatcctttttggcggctgtctgcgaattgaagcgcttcgcggaattgaatcggctttcttacaatatcccagaaaaagtccgcttgtatatcggtctcagcctctccggtcgcactggagatgtacggtataaacggagtccggattaatttctgagctaaaaagcgcttgtacggctgttccgcctgatcaaccagcgctgagtgaaacccgtaagataccggcaatagctgatgaggaatctgcttttctctcagatcgtccatgatctttttgatatgttcccgctctcccgagatgacaaagtgagaatgatagtttacagatgccaattcactatgttcgccgagcagcggatcatcttgatataaagccggatcacccagtatcgcaagcatgctgccgttacggcaagtttccgtaatgattcgggcctgttccagcacgcaatctaaagcatcctcagcgctcagcacacccgacacagcggccgctgcatactctccaaggcttgctccgatcacataatcgggacgtatgcctctttgctccaaagcatatgcaagtgcgtactcagccataaaaatggcaggatggctgaaaagaaggcggtcaaatggatcagacagacgattgcctgtatgataaacctctttcaggacagagtaaccgaaacggctgactgcaaaatcgtccaagtcaagcattttctgccgaaaagcggcgttatgtgcaaacagctctttccccatttgatagtattgggaaccctgtccagaaaacatgaaaacaattggctggttcatttgttctcctttttgctctttatttttttaaaatattgatttgtaagtttttcttgatgttgtgtgcaggtgaagtggtcgtgatgttgtatggctggcactattatgtgagataagaattttgacttgcgttccgctacatggcgggtgaagcttcagtttcttttttgatgcggtgaataagtcctgtcagcacatggcccgggccgacttcttcaaattccatccgccctttgtccagcagatagcgcatgctgtcgttccatcgcactgaatggtcgatctgatcggccagaacggagtggattccgtcttgctcataaggcctggcatgcacattagaaatgacaggaattgatatagcagaaaaatgaaatgactgtaaaaatttttcgaactcttgttttgcttcgctcatatatctcgagtgaaaagcgccgctgacgtttaacggatgaaacatcgtaacgtcctttattccttcgaatacgcttttggctctttcaatgtcttctttgcgtccggatatgacaacttggtgaggagaattcatattggcaatatcaatcgtatgtaatccgtgcgtttgaagggcgtccgacacttgagctgcggttaaccccataacggcggccatttttccgtcagtggccatactcattaattcgcctcttttacggacaagctgcaggccggtaataaaatcaaaagcacctgctgcaaacagcgcattatattctcccaaactgtggccggccaaataatccggctttatgtcattttcttggatttttttcaaatagcttaacgcgtttacaacatataaagcaggctgggtgaactgcgtcttgtgaagattggaatacggattctcaagacaaagccgtttcatggaatatccgagtgtttcatcagcctgctccgttaagtctttaaattcatcaaacaatgagcttcccattccctgcttttgagaaccttgtccggggaatatgtatgtgatcattttctcagccatcctttctcggattcagttaagaagcatgttcaagttgatagtaacttcacaaaaataccatgtcaagttaatttatcctatgcggaatcctgaataatgcctatttttccctgacggaaggcggactcagggcttttggaatagacataagcagaatgtcccattcagcctgcccggcgcttttatccgcaaactaccgttactcagccattcatcaccaaaaagcgagcaatgactatcatttcaattcagaagttccgtggcctaaaagaaaaactagttagatagaaccaaattatacgctacttaaagtgaaacagccctttttgattttttctgttgcggaaattcacgaaatgttcttttttttcaatctgaaagtaaatattgtttttcaaaagactctccattttttgacccggcttctccccgaaggagtgccccggatacacacgcacatgcggcggaatagaggctttgatcctctgtatactgtgaaacatatcttcagctgagctgcccctgtcctcacatataccgcacccttctgtaaacacggtatcaccggtaaaaaggtgatcagatagcaaatagcacattcccccggccgtatgtcccggggtcaatatacttctgatgataaaccctccggccgcaaaggtttgtccgtcttcaagcgctattaagtttctgcaccggaattgatagaaatcgatttccgccgacgacatgtatatatcagaatgatagatttgctgaagcggctccgccaagtttacatggtcataatgcgaatgtgttaataaaatagctgataaatcaacatccaattcatgcagtttatcggttattttatcgatttcccaggacgggtccaccgctatcgcagatttttttgagcggtctgcgataatataacaatagttggaccacatctggtgataagttttgatttgatgcacttcatatgtatgatccattgtcaccattcccatttaaaagatccgggcagactgctgccgccgcccagccgactgtaaccactttaccagatggcaccacgtttttccatggattttccggtaaagtttaaaaaactttctgctcccgccaaaagcaccagtctgggccttttttacaaattgctatgctgatatataaggaaatcagaatattaattcagatgaattctttagggaattttattcagaaaatgaaggatgaatatgagtttcggataaaaagaaaacaaattgaacttttgttttgagaagcaattacagaagcggccggaggagataatcagtttttagaaatgacccgcaattaagattattatttcaatccttttcttcagataaactaaaccacacgggctctcgaaatatatcagaataccttagttcttacaccgaattcaacgttatgttgacattaacataattgaactgagaaaagtacagcttaatttacactctttttttttgcgagaaaaccgttcaaaaaccagtctagctgcaacaattcacgaaagcgtcgcgcatgaaaaaagacgtcagttgaagacgatttatatttgattattgacaaggagctcagatgtttttgttagggctaaataaagttatctttttactgtgtaaaaagtaaatattaagatttagacaaatagactatgtgatatgggtcggagtttactgttcaaggtgatttgtcctgagctataaaagcactgagagcagctcgggacgcaatacctactaaagttaaagctgctatgggtggaatcggcggttttgaaataattcttaatatcattgacaattttactggtgcagttgaagatgcgtgctatgcggatgctctaaaagtaactggtaaccaggcagcaactttgtgggttactaaaactcttatgcttttcctttaaatggggctattgttggtgtttaacaaatttatcctgtgttaagctttaaagtgattattttctaaagtgtttaagatcggaggtaactatggaagataaaagtaatgctgaaccgagcccgaaagctataagaattctaacttacatcattcctataattttaatagggcttatccttgtccttaagaatattaacaccgccgcagcggaaatttcattttatattgttgctgtcggtgtggttctcttagtggttttcagtttgatcaaaaatagaaaataccgcaggaagaactaaatgtaagggggctaatcactagtcccccttgactgacttgcggatagtataacccgccaaattccaattttatttaaattcttccccatctcttccctgtgactttgtaaaagcaggtacccgcatacagagtattcatcttgtacttcagggatccttcccaaataactggatgttaaacaaattatcttcatgatttacggtataccatgcaacaattatgccagaactcaaaagttatctctgaaaggctgggtcattcaaactagtaaggctgcttgtgggtaaataacagtttagtctcacataaacgttgttattacatcacacgcttaaacatcttctccatttcatacgtactgtggtggataatgatcggccggccgtgcgggcatgtgaacgggtctgtcgttcggcgcaggtcgtccaagagcgctttgatttcgtcgtttctcaaatggcggttcgctttgattgagcctttgcagctcatcataatggccgcttcctccctgagttttttaatatcgatctgtttggcgtcaagcacctgctgaatgatttcttcaatcagttcagcttcttccccttttggaaaccaggccggatggcagcggacgatgtagctgttcgtgccgaatgcttctaaaaatactccgacgctttcaagctcatgctgatgctggtcaatgatcagcgcttcatttgccgcataatgaaaggtgagcggcacgatcatatcctgcacttcaggctcgacctgcccgactttctcccggaaatattcgtatttaatccgttcttgcgccgcatgctggtcaatgatatacaagccgttttcgttttgggctaaaatatacgtcccgtgcatttggccgatcggatacatcaccggaactctttcttcccgtatttcttcagagtcagcctcctcttcaggctccggaatatcggaaacaggcgcttccgttaccggcatgccgagctccggcggcactccgtgacctgcttcatccggcagggactcttcttctatgaccggctccggctcttttacgaccgaactcagcttcatcggtgagtaagacggctccggcgttttttcaggaagtttccgctcaggcgcgctttcctcgaatgtcataaattgctgttcgtttttggccggtgccggcgctgtttttttcgggagctgggcgctcggaataagccgctgcttttgaaacacttcctttatcccgtcacggatcagctcatgcagctccgtctctttgctgaggcggacttcaagcttcgacggatggacattgacatcgaccaaaatcgggtccatcgtaatttcgataaacgtaatcggatggcggccgatcggcagaagtgtgtgatagccctcatgcaccgcttttacaagcgggaaattcttaatgtatctgccgttaatgacagatgacatatagtttctggatgcacgcgtgatttctggaagcgcgatgtagcccttgacttcaaaatcaagcgagctgacatggagcggtatcatttttttcgcaaccgccgtcccgtaaattgcggccagcacatggcgcacgtccccgttaccgtttgtctgcaacagatttttcccctgatggcggagacggatggatacttccggatgcgcaagagcaatccggttgacaacatccgtaatattgccgagctccgtatgcacggttttcatatatttcaatctggcgggcgtattgaaaaacaggttggtaacgataatctccgttccttttctgctggaggatttctgttcagaaatgatattcccgccctgaagaatgagatgggttcccgccccctcgccgatgctcgttttgatttccagatgagaaacagacgcgatacttggcaaagcttctccgcggaaaccgagtgttctcacccggaacaggtcgttttcatctttgattttgctggtcgcgtggcggcggaaagcccgcttgcaatcatcggtttccatcccttcgccgttatcgagcacccgaatcgacgaaagccccgcttcctctatgtcgatttcaatgactgtgctgtttgcgtcgatggcgttttccaccaattctttaacgactgaggcaggccgttcgaccacctcgccggccgctattttattcgaaagttcatctgacagctggatgacttttgccaagtccgtcacctctttctattttaattttttttgcagcttgtacatttcattcatcgcctcaagcggcgtcatatcgagaatattgattgacttaaaagcttcaagcacttgtttttctttattagaaacagccggtgccttctgttctttttcaccgtcagcaaaaaaggacagctgtgccggttcttctttgacggcgggctttttctcaggtgccgccggaagctccggtttatctcccgtctgctcaagctgtttcaaaatctcctgcgcgcggctgatcagatcgtccgggagctccgcaagctgggcgacatgaatgccgtaacttttatctgcggctccttctttgatttgatggagaaacacgaccgttccgttatattcctctgcgcgcacatgaacgtttttcagctgaggaagcttatcttcaagcaccgtcagctcatgataatgcgtgctgaatagtgttttagcgccgatatgatcatgaacatattcaataatcgcctgtgccagcgccattccgtcgtacgttgatgtcccgcggccgatttcatcaaacaggatcaggctgtcttttgtggcgttcacaatcgcgtttttcgcttccagcatttccaccataaaggtgctttgtccggaaatcaaatcatccgccgccccgattctcgtgaagatttgatcaaaaatcggcagaaccgcttcttttgcgggcacaaaacagccgatttgggccatgatcgatagaagtgcgatctgtctcatgtacgtgcttttacctgacatattcggacccgtaataaggagcatttcccgcgaatcgcccatcaggcagttgttcggcacgtattcttgactgtccatcaccttttcaacgacggggtgtctcccttcaatgacttttacttcattatcagaaaagacgggctttgtgtaatgcctgttttcactgatcgtagcaaagcattgcagcgcatccagctcactcatttgtttggcaagacgctgcagacgcggaataaattgtttcaccttttcacgcagaccggcaaaaagctcatattccagctcgcagatgttgttttccgcttctaaaataagcgcttctttttccttcaattccggcgtaatgtaccgttcggcgtttgtgagggtctgcttccgctcataccgcccgtcctcaagcagatgaaggtttgcttttgtgacttcaatataatagccgaacactttattgaaaccgacctttaatgaacggatgcccgtataagcgcgttcctgctgctccagtctggcaatccagtctttaccgtttttgctggcgtcacggtactcatcgagcttctgatgatagccgtctttaattaagttgccttcttttaacgataacggcgggttttcatgaagggcttcttctaacaggtcaagcaaatctccgcacggatcaatcaagccggcgcgttcttttgcttttttatggttaagagatcctacaagctctttaatgctcggcacttgttttaaagattctttcagctggattaaatctcttgcgttgacgtttccgaatgcgacccggcccgccagacgttctaaatcgtatacttccttcaggcgctcgcgcagatcttcgcgctcaaacagatgattgatcagcgtctcgaccatttcctggcgttcttcgatttgggatgccctgatcagcgggcggtcaatccattgtttgagaagccggccgcccatcgctgttttcgtctcgtctaaaagccaaagcaatgacccttttttgcttttcgaacggatcgtttccgtcagctcaagattccgttttgaatacaggtcaattttcatcgcttcttccaattcatatacttgaaccggctgcagatgatccaggctccgtttttgcgttttctgcaaatacgtatataaacgcataaacgtctctgtcagctcttcgcccggcaagtgctttgcgatttcaatgcgttctgttatttccccgtcttcgatagaaatcgttgcgccgcaccgttctttcagctgagcagccgtatgttcgttaaacttgcttgatacgacaatttcctttgcgccgactgagtaaatttctgacatgacatcttcaatccgctcaataaatacggccaggttttctccggtcgttaagtctgataaagcgagaccgtatccgttacgaaattcggaaacggaagcgataaagttgttttccgactcatggatgccttttccatccatcacggttcccggggtgatcagctggacgacttctctttttacaacgcctttagccgccttcggatcttccgtctgctcacagatcgccactttatagccctttttaatcagctgttcaatataagccgccgcggaatgatacggcacgccgcacatcggaattttatcagccgaacctccgtctctgcttgtcagtgtaatttcaagctcttgcgacgctttttttgcatcttcaaaaaacatttcataaaagtcaccaagccgaaaaaataaaaaggcatcttggtgctctgcctttatcttcaagtattgctgtatcataggcgtgtaactagccatcatttaatccctcactatgtatcttctcttatccgaatcccattataacataaacaaaagagtgatatctttatatataaaaaagagactcggggtgttaaactcccctagcctcaacttattcttcaggatctccgactaaaaattcagggttaatgtcctctaattcttcgtcaagatcgtcttcccaatcatcatcatcgtcttcttcccagtcaggattgacttcgacgacgactttcgtttcaccgaccacttctgctaaaaattccctctctgcctgaaccacgattttatttccgttaggagaaatggtgacttcaagacaattcggctgctgcagcactttggcaatgacttcgtgttcgtcatctaagtaatttgtatctctgtatctgagtttaatcacatcgacatactttactctctcggttacaacttccgtttttgtattatcggcgtaagagtaccagacgtttatatcataatacccttcaatttctacagtcttcccgatcttttcggcatcgtacttgtggttgataatccagccgcccagtatacttgacggtttttctccaggcgagatcgtgttggtgcattgggtgaattttcttcctttcgcaactaccgctttcgtaataatttccctgtattcagacattccggcaggcctccttgttcttcttcgtgttatcttatgctgggcatttgtctcatgtgcatttttataataaaaatataaaaatacaaagtttctgtttcattgtatgcagccctgcccagaaactttacttttaagtatgataaaactttccagtaaaaataggacaaaacgttgagacaatgaaaatttagtacatattacaattagttcttaaacggcaaaaaaaacacgggccgatgaaggccccgtgtttaaatagaacagctgttattcgaatgttttacttttgaaccggtttctcccgtcagcaggttgcctccggtagatgtaatgatttcgtttgtcacctgatttgagatcgtatgtgcgacaagctgaagaaggtcattgacctcaatctgggaatctctgaattcctggatgatcggaatcccttcaagctcttcctgcagggcgtcaattttactttccacttgtttcagcgcttcaagcttttcgtagtgcttcaggttaacggcttgcttttgcagggttttaatctgattaataatcgcagagactttttcattttcgttaatctgcgcctcggcgcgtttgaaaaaatcaacttcttctgtttcagaaatcattttcgcaaggttcctagcctgctgtacaatgtctttctttgagtaaagcgtcatcattatttcacctcgattgcttctcctgccatcacaccgtcaagcgaccatgttttcgcctgttcgattttgacgcgtacaatcttgccgatggcgtctttcggccctttgaagttgacgagcttgcttttttccgtatagccggcaagaatgtcagggttatttttgctttctccctcaactaatacttcgacagtcctgccttcatattccttcatttttttggctgaaatttctttcaccaaatcattaaggcgctgaagacgttctttcttgaccctcatcggaacattgtctttcatcttcgctgccggcgtgccttcacgaggagagtaaataaacgtatatgcgctgtcaaattccacttcgcgatataacgaaagcgtttcttcaaattgttcatccgtttcattcggaaaaccgacaataatatcggtcgtcagtgaagcgttcggcatcgccgctttaatttttccgacaagctccagatagcgttctctgtcatatttacgggccatcatttttaacatcgctgagcttcctgattgaaccggaagatggatatggtctaaaaggttgccgcctttggcgagcacttcgatcagatgatcatcaaagtcacgcggatgactcgtcgtgaatcggattctcggaatatcaattttacgcagttcgtccattaaatcaccgagaccgtacgtcatatcctcaaaatcttttccgtacgcattcacgttttgaccgagcagcgtgatttctttatagccttcgcttgcaagtcttctgacttcctggataatttcctcaggacggcggcttcgttcttttccgcgggtatacggtacgatgcagtatgtgcagaacttgtcgcagccgtacataatgttgacccagcctttaatttttccgttgcggactttcggaaggttctcaatgacatccccttctttcgaccacacttcaatgaccatctcttttgataaatatgcctctgataacagttccggcagacggtgaatgttgtgcgtgccgaaaatcatatcgacaaacgggtgcttcttaaggatgcggtttacgactgattcttcctgtgacatgcagccgcagacgccgagaatcaagtccgggttattttttttgagcgcctttaaatggccgagctctccgaacactttgttttcagcgttttcccggatggcgcaagtgtttaataaaataacgttcgcgtcatcaaccgaatttgtcgcttcataaccgagcgccataaaaatacccgccatgacttccgtatcatgctcgttcatttggcatccgtacgtgcggatataaaatttcctgccttcaccaaggcctttaaattcttcagagattttaaaatcgttatgatattgaacggattctttgccccgttttttcgcatcttttaaagaaggcggaatatatacggcttcaaaatacttgctgtaatccttttcggattttttgtccgccggattcacttgtccgctttcctgcttttgcttttcattcatgttcgaatgtctcctttcaaccgaaacttccaccctcaagtatactggttaaaagcgtttggcacaaccgccagcctattattgtacaccttattgagaataagaatcaataagaaataaaaaagagggaatcatttcccccttacacaagctgaagctcttttgcggctgaacggattacttccagggcccggtcaagctcctcttttgtatgctccgccgtaataatggtgcggattctcgcttttccttgggcgaccgtcggatacacgatgctttgtgcaaacacgccgcgggtcaataaaaggtctgataatgcctgggctttttcttcctcccctattaatatcggcacgatcggtgtttcgctttttgtgagggtcagccccatttgaaccagtttgtctttgaaatacgccgtgttctcccatagcttttccatatgctcaggctcttccagcaggacgtcaatggcttctatgcatgcggccgttactgcaggcggatgagaagtgctgaataagaaaggacgccctttatggcgcaggtaatcgatcagaacctgcgaccctgcggcgtaaccgccaagcactccgatggctttgcttaatgtgcccacctgtatgtggactcttccgtcaagcccgaagtgattaaccgtcccccttccgttttttccgagtacgccggaagcatgcgcatcgtcgaccatcacaaaggcatcgtacgcctctgcaagtttgacgatgtcaggcaaaggagcgatgttgccgtccattgagaatacgccgtcggtgacgatcaggcgcatgcggtaattcattgattttttcagcaccctttccaaatcgtccatatcaacatggcggtacacctttttatctgcttttgtcagcctgatcccgtcaataatggaagcatggttcagttcgtcagagatcacgatatcttcttttgtaagaatgcttgataagacgccctgattcgttgtgaaccccgattgaaaaacaagtgccgcttctgtttttttaaaggttgccaattttttctccagctcattgtgcattgtgaatgttccggcgattgtacggacggaccccgtacccgctccgaattcttccgcggcgcgtttggccgcttcgacaagtcttggatgcgacgtcaaaccgagataattgttcgatgaaagctgtatcacgttttcccctttgacttccaccgacggaccctgcttcgtttcaatttgtttcatttgctgccacgttttattttctttcattttatcaagctctgcttttagaaattcaaattctttcattatagaaccctccccttatggaatcaaaatgactttgccgcactgtccctttctcatcaggtcaaaccctttttcaaagtcttcaagcggaaactgatgcgtgatcaccggcgtcagatcaacaaggccggattcaagcaggtgcgatacctgccgccatgtttcaaacatttttctgcctgtgatgccttggacggtaagtcctttaaacaccacgtcatttgtcaggtcaaccgtcaccggacgttccggcagactcagcatgtggaaccttcccccgttggccgccatctttaatccttgtgttatggctgccgggtggcctgacatttcgcagacaaggtcgatcccttcaccgcctgttaaggtgtcgatcacctcaagcggatcttcctcatcaactgaaatggtgatcgcagctcccaatttcttcgcaagagccagcctgtaatcatttttatcaatggccgcaatacgggatgcaccggccgctttagccaccgccaccgccatcagcccgatcggtccgcagccgataattgcagcggaaccgcccgcaagccggctgctttccagcaccgtatgcaccgcgttgccaagcggctcttgaacagaggcgacggcggggtccatatcagcggggtttttccaaacatttcgggccggcactttgacatattcagcgaaggagccggctgtatctacgccgaggatctttgtatgggtgcacacatgatgtttttctgttaaacacgggacacaagtaccgcagacgaagtgggtttcagccgaaacgtagtcacctattttgacatttgtgacgtgcttgcccgtttccgctacgataccgctgaattcatgtccgaatacttgaggtgttttgattcgtttctgcgcccattgatcccaattataaatatgcacatctgtaccgcatatagatgcggcctgtactttaatgagaacttcattctcattaatggaaggtatgggaatttctttcagcgttgctccgaaagcgttttcatttttaacgatagctttcatctttcctcccaacatgtacactcctcctcgaaaaaacactgtaataactggattgtaacatgagataaaaaggaggtaaacaccagtgtccactcgaggaaaacaactgcttccgtccggaaaaatgggcgggattttttttgaatattatatgaataaagccatttatcatctcttcgtactatcaatataatattgtgagaaaatatgacagcaataaaaacaacctgctcgccttacgcaagcaggttgagaatgtacatatttttgtttttaacggggttcgacgattaacttaatcgccgttctttcttctccgtcaatctgtatatctgtaaaagccggaatacaaatcaaatctacgccgcttggcgcgacaaagcctctggcaatcgcaaccgctttaacagcctggtttaaggcacccgccccaattgcttgaatttcggcggctccgcgttctctcaatacgccggcaagcgcgcctgctactgaatttggacttgattttgctgaaacttttaagatttccatttctgctcccccttagttttacaatggataagtgagtgttcattagaacaatcattattagatgttgctatccaaaaagccatccccacaatgcttttcaaaaatagcgggctaccttccatttctactatattcactaagaagttgctatattcctgcttttccttttaatatttttataaaataaacacatgatcacctattcaaagaacatatggtcatcattgattaatatccgttcgatatttacggcctttttcgtttgatcgtcgatgtcaatgagcactccgctcagcgtagttttaccttccgccaccgtaaaccggacgggaagattggttttaaaccgcttgatgaccgtttctctgtccataccgagaattccgtcgtacggacccgtcatgcctacatcagtaatatatgccgttcctttcggcaaaatgcggttatctgccgtttgcacgtgtgtatgggtgcctaccacggcagaggctcttccgtctgtataccagccgatcgcaattttttcgcttgtcgcttccgcgtgaaaatcaataaaaatgtacggtgtgcgctttttcgcttcttctattaattcatccgctttagcaaacggatcatcaagcggcggaagaaacgtccgcccctgtaaattaatgacggcaagctcttttccgttcgatttaatataagtaatgcctttgcccggcgtaccttccgggaaattcgccggccggacaagatgcggcacatcatcaataaagtcgaagatctctcttttatcccacgtatggtttcccattgtaatggcgtcggctcccgcttccatcaggctgtggtagatcttttccgtcagtccttttccgtgtgctgcattttctccgttaataattgtaaaatgcggtttatgtttcgctttcagtttcgggacatattcttttaccatgtcgcggcccggggaaccgacaacatctccgataaataaaattctcatacattccattccttccttttcagggactcaaaaaaataaagtgatgcgctaagcatcactttattttgcatactctacggctcgagtttctctgatcacggtcactttaatgtgtcccggataatcaagctcgtcctcaattcgtttacggatatcacgcgccaaacgatgggcttctaaatcattaatggagtccggcttcaccatgatgcgaacttcacggccggcctgaatcgcaaatgatttttcaacaccttcgtaagactcggagatttcttcaagcttttcaagtctgcggatatagttttcgagcgtttcacttctcgcgcccggtcttgcggctgacagtgcatcagcggcagcaaccagaacggcgataatggaagtcggctcttcgtctccgtggtgtgacgcaatactgttaatgacgactggatgctctttatatttggtcgcaagctccactccgatttccacgtggcttccttccacttcatggtcaattgcttttccgatgtcatgcagaagaccggcacgcttggcaagctttgcatcttctccaagctcggaagccattaaaccggctaaaaacgcaacttccatagaatgtttcagtacgttctgcccgtagcttgtacggaatttcaaccggccgaggatcttgatcagatccgggtgaagtccgtgaacgccgacttcaaacgtcgtctgctcacccatttcccggatatagtcatcaacctcacggcgggatttttcaaccatttcttcaatgcgcgccggatgaatacggccatcctgaacgagtttatcaagagcgattcttgccgtctcccgtctgatcggatcaaatccggaaagaatgactgcttcaggtgtgtcatcaataatcaggtcaatacctgtaagcgtttcaagcgtacgaatgttacgcccttcacggccgatgatacgtcctttcatctcatcattcggaagattgacgaccgataccgtcgtttcggcaacatgatctgctgcacagcgctgcaaagcaagcgacagaatgtttttcgcctttttatctgcctcttctttcgcacggttttcggtttcttttgtcatgatggcgatgtcatgtgaaagctcattttcaacccggtcaagaatgatttgtttcgcttcatcccgtgtcaggctcgaaatgcgttcgagttctgactgctgcatacgaatcatctcatccactttgctttccatctcttcaatatgttgttgtcgttcattcagagaatgatctttcttctccaacatcgcttcccgtttatcaattccttcatgtttacggtcaagattttcttctttttgaagtaaacggttttcttgtttttgaagctcatttcgtctttcacgaacttcctgttcagcatctattcgaagtgtatggatttcgtcctttgcttcaagcagagcttcttttttcagtgcttcagcatcacgctttgcatcttcaaggatttgctcggcagcaccgcgtgcgcccgcaatctttgcttcggcaatggttttacgaacatagtagccaacaactaaaccgagcagagtcagcaaaatggagatgagaaccgtcattggggtcatactttcacctcctcttgctatgaacttggtttttgcttaaataagtgccggcatgtacattgtctgattttctcaacatacagaaccttcacagggaatgagtctctcatgcccttgtcaagtttaaatggtttaacaatcatgttaaaaaaacaaatgttacaacttcattgtaattgtgtcggaaatacttgtcaagcttgccagcttaacgattcgccttcagctcggatcgccgcccatgtatatatcataccataccttcatccgcttttcgtgaatgacggctctgtcagtccgcctggttaagcaattggtaaattctattgtttacctgtcctaatttggcgttattctgaatgtttgacagtaatatgacatatttgcttgccgaatggctgaaactgtttaaaatgttgtaaccgggcataacaccgtgattggaatagctgcccggatcaatgtaaaaccccatcccgtaagcggcactgcttcctgctgtaaacatttttgtgaagctttcttttgaaaggagcgtgccgtttacgatcgctttatcaaatttataaagatcttcagcgctcatatacatgtcgcccgccccgtaaagctgcgataagtccaaaaggtgcggcgttacaagactgccgctctcatcgactttgtagccgacggcaggatatttggcttcagcaaatgttttgtaaaatccggcatgcttcattccggccggtttgaacacgtgttcttttatatattgttcataagactccccgctgacctgagatgcgatataagcaagcactgaatagttggaatccctgtaatcccaaaccccgggctgccttttaattccgcggtattctatatccttgattaaatcaattggagaaatcggtccccgaccctcaatatgcccgtttatgccggacgtatgattgagcaggtttttcaatgtgatgcgcgtgccgttaggaaaattcggcaagtatgtactgacggggtcactcgtctgcagcagccctttttcttcaagctgcaggacagccgtcgcgattaacgctttttgtgaagaaccgatataatatgatgtctccggattgtttttaattttttgttttcggtctgcatagccaaagccttttttcagcacaacttttccatcttttacgatcattgctgtgccgctgaacccgatctgttgcaagtaattgctgatctgtttattgtgatcgattgatttaggtgttttctctttttgcgtcttttcttttttctgttgagtctggtcttttgaagtatcagattgagcggcgggagcgtttttaacggattccttctcccgatgatgcgctgtgacggtccagatcataataaaaacagtgacaagcagcagaaaaagaaacagccctcccgttttcatcagcttcttctttctttttttatttattcttgtgcggcgggggctcgtcatcttttttcctcctcagatataatttcaactttcgccatgatgttagacgagtgaagggtgaaaaaagttgtaacattccagataaaattttccgaaacagccagtgtttttttgaaacatacaaaaaaaagagcggaaattgcttattccgctcttttgatcgtgtttttattcttctaattccatctcttcctgaacttcttccgctttgtccgttacaccgttattgtctaaaccgtaatattcacggatttgttcctgaatcatcagcatgatgtctttattttcttttaagaactgcttggcgttttcacggccctgaccgaggcgttcttcttcataagaataccacgaaccgcttttttgcacgatatccagttcagttccaaggtcgatgatttccccttctttggagattccttcaccgtacataatgtccacttcagccgtacggaacggaggagcgactttgttttttacgactttaattctcgttttattccccatcacgtcgttgccctgctttaattgctcggcacggcgcacttcaagacgcacggaagaatagaatttcagcgcgcggccgcccggtgtcgtctccggatttccgaacataacgccgactttttcacgaatctggttaataaagattgcgattgttttagatttattgatggcgccggaaagcttacggagcgcctgagacataagacgcgcctgtaaaccgacgtgtgaatcacccatgtcaccttcaatttcagcttttggaacaagcgccgcaacagagtcaacgactacgatatcaacagctccgcttcgcaccagcgcttcagcaatctcaagcgcctgctcccccgtatccggctgagaaagcagaagctcttcgatattgacaccgagcttttgcgcgtaaacaggatcaagagcatgctcagcatcaataaatgctgcctgtccgcctttttcctgaacctcagcgattgcgtgaagcgctacagtcgttttacctgaactttcaggtccgtatacttcaataatccgtccgcgcgggtatccgcctattccgagagcagtatcaagtgcaagggagccgcttggcaccgttgaaattcttgtatccgttttttctccgagcttcatgatggaacctttgccgaattgtttttctatttgcttaagagccatatctaaggctgcctgacgatcactcatttattttttcctcctttatcttgccactacatatactataccttgtttactggcatttgccaagaaaaaagcgaacgcatattcggattttttccgcgttcgcttttctgcaaaagagcataatttcccttatgaaacttaaaaatcagagaaaaaagctctttaaaactttatttttgatccagcatttttaaaatgagatggcagccgtatttagcggcgcgctttctgattccggttcttgagccggcaaagtgaaattcgtgcacctcttcttttccttccgctgaaatgccgataaagacgcggcccggcgcatgcccttcctgcgggtcgggacccgcgaccccggtaaagctgatgccgatatcgcttccggtcagctttctcacaccggatgcaagctctttcgcacactctttgctgaccgctccgctttctgcgagcgtctcagctttcacgccgagcacatgctgtttcacgctgtcggaatagcagacaacacctcctgcaaatagttgagacgcaccgcttaaatcagtcacccactctgaaaacaagccgcctgtaaagctttcggcagaagaaatcgtgattttgttttgtctgcatgcttttgaaagctccttcaccagggacgtatcatcatatccgtagaaaaattcaccgacacgttctaaaatggcggcttccgtttcttttaaaagccgttctgtttctttttcgtcagcatgtttcgccgttaaacgcagcgtgacctcgccgtcagcagcaagcggcgcaatcgtcggattcgtctgcgcgtcaatgatatcttctaaatcagcttcaagctgggattcaccgattccgaaaaaccgcagcacggttgaaacgattttctcattagaaccaagctttttaagaagcagcggtttcgcttcattttcaaacatcggacgcagctcgctcggcggcccgggaagcagcatataaagccttgagccgtgctctgcaagcattcccggcgccatgccgaaatgattcgccaaaacgtccgagccctcaatgacgagcgcctgtttgcggttattcggcgacatggtccgttttgttttcgcgaaatattcttcgatcgaccggaacgcttcgtcattcagaacgagcgggcgccccagtgtgtttgcaatggtttctttcgtcaaatcgtccttggtcggtccgaggccgcctgaaaaaataatcaggtctgagcgctcttcggcaatgcggatgacttgcttaagccgctccggattgtcaccgacagcggtatggtaaaacacgtttacaccgatttccgccagttctttactgataaactgcgcgttcgtattggcgatctggccgagcagaagctccgagccgaccgcaatgatttctgctttttttgctatttccatctttaagtccttcttccttagttagatgtttttaacgcatcccagttcttcgcaaaataatcccagccggaaatgactgtgaagagcacggccacccataaagcgatatcgccgaacgggaaagaaacgagctcaaacggaagattatgcagcaaaagcgcggcaacagcgatgatctgggcccatgttttaattttccccagcatattggcggctacaacttcccccgttcccgccagcacaagtcttaatcccgttacggcaaattcgcggctgatgatgatgatgaccatccacgccggcgcaaggtcaaattgcacaagcgtaattaatgccgcggacaccagcagtttgtcagccagcggatctaaaaatttcccgaagtttgtcacgaggttcagttttctggcgtagtagccatccacccagtcagtcgttgatgcgataatgaacaaaacagctcccgtaagatgcgcgaccggaatcgattcatcccctatatgaacgctgccccaatgaaaaggaacaagcatgataatcataaatacaggaattaaagcgattcttgccagtgtgattttattcggtaagttaaacataaagcccctccaataatatgtactcggacgtgaagaaaaagtcatcttaatcgttcagatgactttttccccttttattttttcatcttgattgtgatggtctgcgccatcatatcatgcggattgagttcataggacagaacctctccgttgattttaattttcaggttaggggcatagcccgtgcggatttcaatctgcttttgatccgtgacgtcttttttaaaggtttcgcctttttgcagcgttccttcttttaaagaaccgccgctgtcatcacggacgcggatccatgcgctgtcagaagcaatcagttcaagcttatacttatctgccccggagacgttgtatgaagaagccgagccttccgttccggccgctttgatctccgtcttttcactgcttttttctttctttttctgctctgacgcttttgtgtcttttttgctgtcagattgcgcttcgtcgtttgtattgccgtcgtttttcagcgcagaatccttaggaatctcatacttgctctcactttgggtgacggccttatctccgtctgtctgcccggatttgctcattccgaactgaataatcgcataaatgatcgcgatgacgataatgacaccgatgacgacaaggacggtcggaagccattccgccgcctttgaagcggacttaggaagctccctttgcatggcgagaccggagattttttccgacacatcgtcatggtacgtgttagggatgtcttttttatattcttcgaataactgatctgaatcaagcccgacagcttcagcgtactgcttgataaacgcccgcacataaaaattgccgggaatgacgtcataattgccttcttccagagcggttaagtatcttttctgaattttcgtcgccgcctggagttcatccaatgacatccctttttcctctctggcttctttaagccggattgctaattctgtcacaacaaacaccttccaatattaaaaatcaaagcttgaaaaaccggtctggtcaaacatttgcggttcttctgcatgttcatatgtaatgacttcgtcaggatcatttctgagttcgataatataatcgaaatcatcgagcgtatactccgaattttgaacaaaaatatcggggtgctccacgacctttgtcgccggaagccgcataatttcactgacgagctgaagatggcgctcagatccccgtcttgtcgaaacgatgccgtcgaggataaacacgttttccgtgctgtattcatcggcaaccagctggctccggatcgtttgttttagcagcgttgatgatacgaaaagccatcttttgctggcacaaacgcttgacgcaacgatggactccgtctttccgaccctcggcattccccggattccgatcagtttgtgcccttcttttttaaacagctcggccataaagtcaaccagaagaccgagctcgtccctttcaaaacggaaggtttttttgtcatcggcatcacgctgaatgtatcttccgtggcggactgcgagacggtcgcgaagcctcggttctctcaacttcgttactttaatggtctccattgtttttaaaattgattccaatcgtttaatttgatctatatgccggcatctgagcagcattccccttctggaaaggtcgacaccgttaattgtgacaatattaattgacagcatcccgagaagagatgaaatatccccgagcaggccggggcggttcacttgaatttcatattcaaaataccattcgagctttgccaaatgatataccccctccattgtggcaaatttttaccttcctttatcataaaacatttttctctaattagaaagaagaatgttgctctatagaggaaaacataaaaaaagagaggagaaatccccctcttaatgagtgctgttattttcaacaagcttcaccatcatatttgcgatggcgcgctgttcatcttcagaagcaacgctccaaagatcagcaagcactttttcctgatggtttttcgagtcgacttcgttcgcaaggtaaccgccgatttctgtcgcgaggtcagtgatcgtttcatcactcatccctttttcctgcgcatagttcaatctgtcgccaaggaaattcttccaattatcccagttttctaatactgacatgttgggttcctccatttcatctgttgttacaaaattattttgtccgtgcagatgcaaactatacacacatttttttcagcagtgccagccgccgtttacggataatatatgccccgtaatataggaagccttgtccgataataaaaaggccgccgcttcggcgatttcctccggcttcgccagccggcccgcgggaatttcctctgccaacgcttctttttcatcagacgtgaactgatcaagcatatttgtatcaacggcacccggcgagaccgcattcacgcggacgccgctcggagcgagctctttggcaagcgctttgacgaacgaatgctgcgctcctttgaccatgctgtataatacctcgcacgatgcacctgtttctccccagacggaaccgatcgcgacaatgcccccgctttttttccggatcatgccgggcaccagattacgcgccaaaagaaacggactcgtcacatgcagctgcaccatctcccgcgccgtgtcatccgtaacgtccgtaatcaggccgaaatgacttttgccgctgtttaatatcagagcgtccacaggctgcttaacggaacggctgagtgtctccgcgccatccggtgaggacagatcagcctggatagcggaggcttttacgccgaatgatgcgctcagcctttccgcaagcctgtgtgcggcttccttattagaatgataatgcaaaaggacgtcatatccgttttttgcgaggacttcacttatactttgtccgattccgccgcttgctccggttacgagcgctgtctgtttcatcaatcaatactccttctttccccagaaaaacatccctcagggcgtgagggatgttttgttatgattttggcacgactttgcagactgtcagcctgtcttctgatatttcttctttaatgacccgctttacgtcttccagggtgatctgctccagtacggttacgacatcaaacagactcatatctaaaaaggcgtagcgtgtgaattggttggcgatgtattcaggcgaattgagcgcttttaaaaatgacccgatcttcttttttctcgcaaggtcaagtttttccgcagttacggctgattctgcatcaagcagcatctgttttaattcgtcagcgagcttatccggctctggtgtatctcctccgacagaggcaaagccgaatccgtattcagccgtgtaatcaaagctgaaggtttcatcaatgtagcctttatcgtacaagttgccgtaatgcggtgagctttttccgaagagacattcaagcatgaggttcatgctgagctcgtgcttcaacagctcccgccccgttttataagggtctttcgcctttaaaccgacaagacattttgagccttgcacgttcatttttaattcctgctcccggcggaaaaccgcttcctgctcctgaacctctttacgtttgatttcaggctggtctgtaaacggctttttctcctggtttttccgcacctggctgatgatcgcttcaggatctgcggggccgacgataaagagcagcatattgctcggatgataaaacgtttcgtagcactcatacagcagatctttcgtaatatgagagatgctctccaccgttccggcaatgtcaatttttacggggtggtctttatacatattttcgataaggccgaaaaacagccgccaatccggattatcatcatacatattgatttcctggccgatgatgcctttttctttttcaactgatttttccgtgaaatacgggtcctgaacaaaatcaacgagtgtttccaggtttttctctacattagaagtgctggagaacagataagcggttcgtgtaaatgatgtaaaggcatttgccgacgccccctgcttactgaagtcctgaaacacgtcgccgtccgctttttcaaacagtttatgttccagaaaatgcgcgattccgtcaggcacgtgtaccatttcttccttatttaaaggaacgaattgattgtcaatggaaccgtactttgtcgtaaacacggcgtatgttttattaaaaccctgtttcggcagcacatagacatcaaggccgtttgccattttttcatgatacagcgtttcctgaagctgttcgaaatttatcggtttagtcaagatgctccccccgtcccttttaagaaataagtcgtatccagcttaatgttctttccgacattgataatgtcctcttttgtcactttctcgatattgtcgaggaaagtttcgatcggtatttccacttgggctgaagcctgctgatacagaaattccgctaagccgtatgccgtatcaatcgtttctaacacttggtttttaataacggctttcgtttgggcgatatcgtcctctgaaaagtcaccgttttgcatagcctgaaattgttcttcgataatggtgacggcctgcttataatttttcacctcaatgcccgacatgaccatcaaaagccctttgaagctttccacccttgaggctgcataataggcgaggcttgctttttcacggacatttataaacagctttgaatgagagaaacccccgaacagcccgttaaacacctgcaatgccggataatccggatctgtatatgtcgtattggtccggaatccgatattcagcttgccctgcttgacgtcctcttcatcaatgacttccttcggatcgggctgttcattcgtcttgcttctttcaaaaggctgcagctcccgttcttccgttttaaaatacgtatcaacggccgttttcacctgatctgaatcaacatcgccgatgacgtacaggtccagctgatcttcgcgtatggctttttgataggcttcatacaactcttgcggtgtaatgtgttcgacatcatcgaactcgccgttgacgtgaagggcatacggttcgcttttgcacatttcctgaacgagacgcagattagaatatctcatcttatcatcatatacggcttgaatccgctgtttcagcgtccgtttttcctgcgtgacataaaggggcaggaaggcgccgttttccaaagcgggcgaaaagacaagctctgataaaagctgaaggcctttttccaataacggtgtgcggtccttcagatacttttcgttaggaatctcaagtctgaacgtaatgacatgacgttctcccttttttgtcagatcagctgaaacggatgtgccgtacagctcatcaaaataagaacgcagatcagcggttttcgggcggctttctgttccgcgcagaagcacatgcggaaacagcgccctttttgttacgagctctttcgttaaaggagccagcattttaaacgtcagcgaaacggttttaaatttctcagtctttacgatgtgggcggtgatcccgccgtgctttgacttcatttcatttacgtaagtcatgtgaaacctccttcgttcattctttaatagtatgtattatggccaaatttcaggattcgcaaaaaagagtgcgcagatgtaattatatcaactggaggatttataaggaaacaaaaaacctctgcccgaaaacaggcagaggcattgaacgttattttttcaaattgaaaggccaccagttggctcttccgaatattttcaccatgaccggcacaaaaaacggaaggacgacaattgcgtacatgagaaggcctgttaataccacggttgcaatctgtaataaggaaagaacgcctgacggcagcatggccgcaaaggttcccgctaaaataatcgccgcagaaatgatgacggaacccatatttttcatactgctgatcattgcgggttccgttccttcttttttcagctcattaaagcggtccattaaaaagatggaataatccacaccaagagccatcaaaatgacaaagccgaagaacggcacggcccagtttacgcccggatacccgaagaagtgtgtaaagatgtattccgtcacgccgatggatgcgaaatacgtcagtacgagcgacgccactaaataaacaggcataataagagagcgcagcattatgatgagaatcagaaaaattcccgccagcataaacattgccgtccgtttgaagtctgaatccgatacttctttcagatcggcattcatgctggagactcccgaaacgccgaaagaggcattcttcagatccgtgttcggaatggctctttttacgctcgctttgatcgcttgaatatcttgaatggccgtatttgagtaaggattgttatcaagaacgacggtcaattctgtcgtttttctgtcatctgacatgtacgtattaaacacgcttgtgaaatcactgtttgtcaacgcgtctttcggcacaaaccagcctgtcatttctttatctgaggccttgtgaagctcacccaggtaatcattcgcccccatcatgccgcttgatactttcttaagcccttttacactatcgttaaggcctgaagaaagatcgctgagccgggaagaaaaatcaccgagaccgctcttcatttttttctggccctccgcgagctgtcctgccgccgattcaaggcgcggcatttgtcctgcaagagccccctgtccgtctgacacttgctgcagaccgttttcaatactggtcagaccggtgatcattgcgttaatttgagtgtcgatctttttttgagcggctgccagccgggcaaattgtttttccgcttgctgcagatgatccttttgactgtcgacctgtttagaaaacgcttctgcatccgcgtttgccttggaaacggctgactgtacacccgtaaaggccgatttgatttctttgtaagagggatcggttttgactgacggtattgacgcttccaattttgcaaacggcagccgggcaagctgcttgttcaaatcggcaagctgtctgctggtttcatctttcatcggcaggacggtttttaccaattttaaagcgttttgcgtttctgaagcgagaccgctgttttgtttgagctgtgaagtcagcatttgtttttgctcttcaatctgctttctcatctgggcgacgccggctttattctcattcacgcctgcctgcagtttattcaggttttcgcctatatcagaaagcccggatttcagagacaatgttccgttaataagctgattgacgcttttccccgactcttcgatctgcggctgtgaatcagctaacgactttgcggcatgccctaatccgtccgtgattttttcaagtcctgtattgcctttatcaagcccttcttgaagctgctttgcctgatttgtgacaaataattgattcaatccgtttccggcagggcgcgtggcgcttctgaccgtttttacaccctctgttttttcaagttctctgctgattttttcgatatcaatcaggtgtttttcggtatttagaggctcatcatttttgatgacgactgtggccggaagaagctcccccgggccgaatgcgtctgaaatcgtattaaacgcgcggacggattcatatttatccccgatttcgtcaaggctgttgtaagatagcgatcctttgtaaagaaggatcggcgggacggtgaataccgcaacgattgcaagactgatgagcggccttttaaatgaaaaccgccctgccgtttcccatgctttactttgaggatgggaaatatcacccttaacgggccaaaacagtctttttcctaaaacagccataaaaaacggcacgatcgtcatgagcgcaagcagcagcaccgcgacaccgactgcaacggcggctgccgactgatacagcttaaatgtcgcaaacccgatgcaggcaaatccgatcagcaccgcaccgccgctgtacaaaaccgtctttccggccgttttgtaggtgacgacgatcgcctctcttatatcagcgccatgcgacagttcttctttaaatctgctgagaagcagaatgcagtagtctgtgccgattccgaacataatcgcaaccatgaaaatctgcgtaaaagttgagagcggaaaattcagctggtcgactaaaaatgcgacaatcgactggctgactaaataagatatcaatacagataaaagcggcacaaacggagcgaccactgaccggaatacaaggatcagcacgatcaggataaaagcgaccgttatatattcagtctttttcaatccgtcctgtgagctttttaacacatcttcatcgatcagcgactggcctgtaatgccgtatgatacgccgtacggtttcagctctttatcaattttatttttgatttcgaggatatcgtttttggatgtatcaagctgcagctgaacgagcatcgtttgtctgtcttttgacagcagctgttttttgatgtcgtcatttttctccccgaagtatgaagtcaccgttttaatctgaagcgcttttttctgttcagacaaagtgctgacggcttcttccagacgatcttttttgtctgtcattaagcctttttcgtgaaatacgatgacggcagaagaagacggtgcatctgaatcagacatttcatcaagcaattcatgggcataagaagaggaatatccgtccggtacggaaatctgccctttctcccgtgtcaattcagccatatcaggcgctgtaagcataaatatcaccgttgcggcgatccataccgcggcgatgatccagcgggctcggataatgtttttcattatgtctgctgatcctcctctgtcatcatcaatcgatataatttttcatatgtattaacgaacatctccgcctcgtcttcatcaaaatacataatatatgaacggacgagttcctcaatccgccgctccacacggtgaaatacttccgtccccttttccgtgacatttaaaagtatgctccggcggtcgctttggctgcgttctctattgatgtagcctttttcatacaggcggttcgtcatcgatgtaatggcgcttttgttgacgtggcacaccgcggccagttcaattgatttgcaatccggattgagcataatatagcggagtatgtaatattgatccaatgtcagctctttgttcactttttcagcgataatgctgtcaattttttttaagacgtgcaggtatacatcggaataacgctgaatcagctgctttactttttcttcatgcatcttttccccctccttccaatagttaaaatgtttaactattaaaaaggataacgacttgacgatatcatgtcaatcttcaaaataaaataaaaaaagacagtgcagattacaccgtctttaatgattcctttttttcttttgcttgtgatgagatatttaacagcgctaaaaatacagacacaatgccgcaaaaagcggataaaataaaaatcagccagcctgcatttgacatcagggcagcaaagatcggcggtcccgcagctactccgataaaccgcatgctgttataaaatgaggtgatggttcccgattcctcgttgtctacgccttctgtgatgacagcgtctaatgccggtaatgctattccgataccgataccgctgacacacaaaaagataaataataaataaaaactgtgattccaccataggccgataaacgacagtgtcacggcactcattccgaaaacgatgcagaacttcattttgccttggtctttcccgatttttctgcctgatatatatgaactgacggatagaaataaaagcgggattgccaaaagcgctcctttagccacaccgtcaattccgtatttcttctccagtgagtctgataaataaaaaagaaccccgaacagcaaaaacataatcacgcagccgatgataaataccgtaaagagccagcgtccgtcacgcttaaatatgcggccgacattttttacaaattcggaaatagaaggggcttctttttgtttctccggctttgccaccaaaaacaatacgagaaaaaaactgataagcgaaaaaaacggaatgaaccaaaacggcataaaccaaaaccatgcagccaagagcgacccgagaatcgggcttaatactttcccggccgtgtttgacgtctcaatgtcgccgagccccgcggtaatccgctcatcatcccctttgaataaatcaccgataaacggcatcactacaggagccgcccctgccgaaccgattccctgcagcacccgccccgccaagataatgggataaggatgcttgaacgcggtggaagctatcgcggcaagcgctccgcccgcaccggctatgagaagacaaggcagaagaaccttttttcttccgaatttatcggacaaatatccggcaatcggaatacaaataatcgccacaatcgaatagaccgttataattaacgatacttgaaaagacgatatggacagcttcttttcaatcatcggaagcacaggaatcagcatggaattcccgagtgtcatcacgagcggtacagaagccagagcaatgatattttttgttccatttttcttcttactcaacttattcacccattcactatacttggttgtttcctgttttattgtgccttgcggaaaacaaagtatgtattgaagcggcaaataaaaaaacagacacatgacgcgtctgtcttaaaaacgttttcttacaacatgaaaactgaacttatcagcccggaaataatttaatgaatacagcacaggttcatcattctgattatagtgggtttgcttcagcaataaaagcgccgtctccggctcgcactccaaaaccggtgaaatcgtatcgtgatatccgatcggttcgatatcggcaacggcatagctgatcacagacccggagtttttttccaaaagatcaaaaatagattcctgttcatgacagaaagaattcggcagaatgtgcatcggaatcgtatctaaacagtaaacgaccggagtgccgcttgccgttctcacgcgttccaaataaaaaagctcctgctcaggctcaagccggaatctagcgatatcttcctcagacggcgtgatgacctgagacgacaaaaaaatcgtacccggcaccatgttcgcctgctgaatcattttcgtcacgctgttgagctgttcaatacctgaaagaaacagcggttttgtatggacgaaagtgcccacaccgtgccttctgataatcacatgctcctcttcaaggatacgcaaagcttcacgcagagttgcccggctgacacccatagattttgaaagctcaaattcagaaggaagcttttccttttcggtgtaaattccgttttgtatatcctctttgattcgctcaatcacttttaggtacaagtgacgattgtcagcttttgtagacatgtttcccctccgtaaaccactttcataaattattgaacaattgggacaactatatcatgttttaataaaaaaataaataggaatgattttggtgatatcattttcagtgaaaactctctcctttttaagaagagagctcatcatattgttccttagataatagtacttccctcggtttgcttccttcatacggcccgacgacgccccgttcctccattgcgtcaatcagacgggcagctctcgtatatccgattctgaaccgcctttgaagcatggagactgatgccgtctgcatgccgataatcaaatcgaccgcttcgtcatagagatcatccgttacttcactgtgtgtttccgacacttcttccggaatcatctcttcttgatactgcgctttttgctgcgtaatcacatgatcgacgacatgctcaacctcttcatccgataaaaatgctccctggacccggacaggcttattcgcgcctacaggcagaaacagcatgtctccgcgccccagaagcttttcagcgccgcccatgtctaaaatggtccgtgaatcggtctgagatgagacgctgaaggcaattcttgacggaatgttggctttaataacaccggtaatgacatcgactgaaggccgctgtgtcgcgataatcaaatgaattcccgccgcccgcgccatctgtgaaagtctcgtaattgaatcttccacgtcggaagaagcgaccatcatcagatcggcaagctcgtcaacaatgacgacgatgtacggcagctcaggctgcttgacttcttcttcggcatttgaccgcttaatatggtcgttatagccttctatatttctcgtacccgtatgggagaacagctcatagcggcgctccatctcattgacgacctttttcaaagcctgcgaggcctttttcggatctgtcacgaccggcgcaagcagatgaggaatgccgttatacacattcagctcaaccattttcgggtcaatcatcatcatcttcacttcatgcggtttggccctcatcagaatgctcgtaataataccgttgacacagacgctttttccgcttcccgttgcccccgctacgagcaggtggggcattttgttcagttcggcaagcacggcttccccggaaatatttcgtcccaagccgatcagaagcttcgcgtccggcttgtcattgagcttggattcaagcacttcttttaacgaaaccatcgcaacttcagcattgggcacctcgatgccgattgctgatttgcccggaatcggcgcttctatccggatatccttggcggcaagcgcgagcgcgaggtcatcgctcagattcacgattttactgactttgaccccgacgtccggatacacctcatattttgtgaccgccgggccgagatgaacttgggtcactttcgcctttaccccgaagctttgaaaggtccgttcgagttttcttgcattctcgtaaatgtttttcttatcggtctgctggccggtatgtttcgggtcagccaggatgtccaatgaaggcatttgataatctttattttcaagctctgtaaacgtcatcggcggagccgcagccgtttcgtcactgtcttgagcgccgccggaaggctcatcttttgccgtttgcgccgtctcctgcgttttttccggaatcagcggttcgacgcgttcttcctgacggtctgaaaagcttgaaataatcggctctgaatggatgatcggcgaaatgatttcctcatcctcttcttcgggctcaggcatttcttttttcttctgaacccgtttttgttttttgcccgatttggtttttgttttcggcgaagacatattcgttctgaccgttttcatatcctcaagaaatgcctgccattgaccgcggataaaccggccgacggggctcgtccactttttgagcgtttcctgcagtgaacgccccgttacaagaatcagccccattaagatcagcacgatcgccatgatctgtgaacccgttgatgcaaataaaaagtgggaagctgcaaacagcaccgcgccgatcatgccgccgcccaaatcaggggaagcagcctgctgtttcatgtcaatcataaacagctcccacgtgttgccgatgacacttgccgaccgaatcgacccgtgatgagacagatttttaaagagctgcacgtgagacagcagcaaaatactggcgataatacagtacaaccctgcctttctcctcgttaaaaggcttggactcttctttttccaaaacagcgaaattccgagaaggaagagcgcaattaagcataaaataaaccactctccggcaaaaaaacggaacaagtacacaaatgtctgtcccacaacgccgagctgcaaaacagcaataatcgagattgcaacacagagcagtccgcttagttcgtattttagattgagcttactctcttgtttctttttagatttccgttttttctttgccacactcatcaccttactgcgttaaaaaatgtaaaatcatacatcatgaagaaaagcagccttttgccggctgcatttttctgtaggattcccctattatagcatattttgcccccgagaaacggactgaatgccggttagattttcagcttgattttttgtcccggagcgatgtccggattcagaaaatccatcgggttcgtacttaaaatctgtacgacttcagcttcatttcccttcatctcaaccagcagcggcacgccggcgtaatctacctgttcatgcacgctttgctctatatcctgaccgtaaacgacttcttgtggcatgacggtataaaggatcattgaatcatccttccttcctcgccctttcgttcctcaatcagctgattcagcttttttatcgcctgtccgacgccgcccacggcatcaattaatccgtaatcagccgcatctttgccgactacgttcgttccgatgtccctggttaagtttccttttgaaaacatcagctctttgaatttttcttcggaaatatttgaatgatgggtcacaaagttgacgacccgctcctgcattttatccaggtattcaaacgtttgcggaacgccgataaccagacctgtaagccgaacggggtgaatggtcattgtcgctgtctccgcgataaaactatgatcacatgacacggcgatcggcacacctatggagtggcccccgccgagtacgattgagacggtcggttttgataaggatgcgagcatttccgcaatcgcaagccccgcttccacatcgcctccgacggtgtttaagatgatcagaagtccttcgattttcggattttgctcaatggcgacgatttgcggaatgacatgttcatatttggttgttttattttgcggcgggagctggacgtgcccctcaatttggccgatgatcgtcaggcagtgaatattggtatcttgggacatttgcggcagagatgtctctcccagctgctgaattttgctcataatgctgtctttcgcatctgatttttcgggctgctgttcttcggtgttttccatacgatgatccattttatctttcaccctttccgaatgtctctttgtattatgaacaaagatgatgatttccatccgggacatgaacaaaaacaaagccggagcatcatgcgctccggctttgtatacattatacttccataatgatcggaatgatcatcggcttgcgttttgttttttcataaaggaattgattcagcgcatcacgcattgcttgtttcagcgtggaccattctacggcagatgtttccgtcgcttcagtcacgatagagcggacgagctcagtagcttgtacaattaacccctctgattctctgacatacacgaaaccgcgcgtaatgatctcagggcctgaaacaaggttcttcttctgcttatcgagtgaaatcacgacgatgagaatgccgtcttgtgacaataagcggcggtctctcagcacgatgttgccgatgtcgccgactccgaggccgtcaatcagaacgtttccgtatgtgactttatccccgattttcacattctggccgcggaattcaacgacatcacctttttcaatcaagaaaatgtcgctgcgtttcatgccgatctcttctgcgattttggaatgcgctttttgcattctgaattcaccgttaaccggaattaaatatttcggtttcagcaaattaagcatgagtttcaattcttcctgcgaaccgtgaccggacacatgcactcgtttttgggcgaaaatgacttgagcgccggcgcgggcaagcaggttgacggttttggaatatatcaattcatgccccggaatcggtgttgatgcaatgacaacggtgtctccttcttcaatgttaagctgcttgtgcgcctgcttggccattcgcgtaagagcggccagcggctcaccatggcttccggctgtaacaattgccacgtcccgcttcggatattttttcacatcctgcacaggaataaacatttcatcttcggcttcaatatagccgagcttgcgtccaagctgaagcacgttttgcagattttttccggcgattgcaagtttgcggccgttctggacggcagcctgtatcacttgctgaatccggttgatattagacgcgaatacagcaatgatgacacggttttctgaattgttcatcgcatcggaaatttcaccgcttacatatgcttctgacggagtataccccgggcgctccgcattggcgctgtcagaaagcagggcgagcacgccgctgtttccgattttggcaatttcgccaatatcacatgattgatgataagcaggcgtctggtcaaatttgaagtctcccgtgcatacaatagagccaagtgatgttttgaagctgactcccactgaatccggaatactgtgaatcgttttaaagaacgatactttcgttgattcaaatgtaatgactgatttagagtgaacttcacgtaaatcagcttttcgattatgcccgtactgcttgagtttttctctcagtaatgcaagcgtaagcttcgttccgtataccggcaccgacagcttgttcaataaataaaagacgcccccgatgttttcatcgtgcccgtgtgtcagaaagatggccttcacgcggtcagcccgttctactaagtaggaaatatccggaatgacgacatcaataccgagcatttcattttcagggtgcatcagccccgcatccactacaaatatgtctgagtcaatttcaatgacatataggttcttcccaatttctccgacgccgccaagggcgataattctgacgttttctgtatttttctttttcaaaatctgtatcctcctagtctcatacccgtccatcatcacttgttcctattataactgatatcaattttagaaaacaagaagaagcggaaggtttagggaaaaccaatatgtatacaaaacggtcaaactcacgataaaaatgagaatgaccgcgtatttcaactgtataaattttttcttacagttcgctgatgacgctgctcaggctcagacgttcatcttcattcagcgggataagaggaagacgcacagatccgacatcaaggcctttcagctgcagcgccgttttgaccggagccggattaggcgctttaaagagctccttcatgatcggcagaagcttctgatgaatcagtgccgcggttgccgtctgcccgttcgtatagtttttaatcatctgctgcatgtcagaacccacaatatggctggccactgacacgactcctcttccgccgactgcaagaataggaagcgttaacccgtcatcacctgaatagacgtaaaaatcttccggcgtttcggcaatgattttcgtaatggcatcaagatcgccgctcgcttctttaatcgcagagatattcggaatctccgcaagtctgatggccgtttccggcgcaagcgaagcgaccgttctgcccggcacgttgtaaagcatcacaggaagagacgtttcttcagctatggctttaaaatgacggtacatcccctcttgggaaggcttattataatacggcgtgacaagcataacgcaatcgacgccggcttcttcagctttttttgtcagtttaatggaatctttcgtattgttgcttcccgtacccgcaataacaggcacgcgtccgttcacttctttgactgtaaattcaaagagtgcaattttttcttccgttgaaagtgtcggggattcgccggtcgtgcctgcgacgactaaagaatccgtgccgtttttcaacaaatagtcgattaatgtagacagtttttgaaagtctacattccctttactgtcaaagggggtaatcatcgctgtagatatatttccgacattcatttttttcacctcatcatgattcaatcacatttactttgaaagttcaaacacttcatgcagcgcatttacggccgttaccatatctttttcatgaacgagcacccagatcgtcgtatggctgtcggcagattgcagaatcggaatgcctttatcagaaagtgcggagacgatttttgacgtgacacccggaacacccattattccggcgccgaccgctgacactttcgcacagctttccgtcactgtcggctcatatcctaattcagccaaaatgctgcgcgcggcttccgttttactgccggctacggtatatacgatttcactcggcgtaatgttaaagaaatctacactgattccggcatttgccattgctttaaagacttcagtctgaacgttgtattgccccattttggcgggaaccttaaattgcgtcacgtctttcacatgggcgatccccgtaatcagccgttcgaatacatcgctgccgatgttagacgaatgatgggacgtcaccaaagtgcctttgtcttttgaataagtggagcgcacgcggatcggcacctttgcctgcatggcgatttccaccgcgcgcggatgaatgactttcgcgccttgataagcaaggttgcagatttccgtatatgtgacattcggaagcggcttagcattttccacgattctcggatcggctgtcataacaccttccacgtccgtaaaaatgtcgataaactcagcatcaaccgccgcgccgagcgccgccgctgatgtatcgcttccacctctgccgatcgtcgtcgtgtcgcctttttcagtcgctccctgaaagcctgcgacaacgacggcatcatggctggcgagtgcagcgaaaagccgctctgttttcatttctataattttggcgtcagtatgctgggcattggttaaaaagccggcctgagctcctgttaaagctgcggcttttatgccgttttccttcagcatgctggaaaaaacaacggacgaaatcgtttctccgcaagacagaagcatatcctgctctctcggagaaatgtcggactggctgccgtaaaggagcccgattaaagaatctgtcgcgtacgggtctccttttcttcccatcgccgatacaacaacgacaaccttataaccttcacttatggcatcttttatgtgtgctagcgcaagcttgcggcctttgtcatcttttacggatgttccgccgaatttttgaacaatgatcttcactattttcactccaaattagtctgacgtaacagaagagagcaggcagagccttactctcttctgttcgcctatagaaaatacgtttgttttatacgaggttcagtttttgcaggctttccgcgatttgaactgagttccaagcggcgccttttaacaggttatcagaaacaacccacaaatgaaaaccgtttgctctgtccaaatctttccgaattcttcctacaaatacatcgcgtttgccgacgcaatcagcaggcatcgggtaaagctgctccgccggatcatcctgaagcgtaacacccggagcttcttttaaaagctgtttaatatcttcaacggttgcgtcatcacggtcaagctcaatgtaaacagattctgaatgccctgtttcaatcggcagtcttacacatgtcgcagccacttccagcttcggcatatgcatgatttttttcgtttcattaatcattttcatttcctcaaacgtatagccgttgtcttggaatttatcaatttgcggaatggcgttaaatgcgatttgataatgctttttgtcgcctttaaccggcataatggacggttctgcgggttcattgtttaaaatcgcctttgtctggctgtacaattctttcgccgcttcattgccggctccggacacagcttggtaagtagatacaatgacttttttcaaaccgtacgctttgcggatcggttcaagcgcagccaccatctgaatcgttgaacagttagggttggcgataatgccgttatgtttgtgcagatcaccttcgttcacctcaggcaccacgagcggtgtattttcgtccatacggaatgcgctcgtattgtcaatcacgatggctccccgttttacagcctcaggcgccaagctttgtgatacgcttccgccggcgctgaataacgcgatatgaacgccttcgaagctttcaggaacagcttcctgcactgtatattcttcgcctttaaacgttactttcgtaccagcagaacgctttgaggatagtagtgtgagtgtttcgatttcaaagtttctgtcttccagtgttttcagcatttgctgtcctacggctcccgtcgctccgacaactgctacgtgtaatcctcttcccatctgtaaaactccttccgccaattaagcatcatttgttgaattgactttgcattttacgttttattttaccatagaatagtcacggattgaccgaatttttttattccggaatgattttctgtcatcatgattttttattcatgatggtgtacgagcaccggctgaacctgctggtgcaaaagagctttttctaccgtaatcggaaggagatccattctggcgacgagcgatgtcggttttttcacgtggtcatcctggccgaacgggatgaaatatatgttttttgcggacatcagcctcattaaattcgttccgtttaaaccgagtccgtcatttgtcgaaattccgagcacgaccgggcggccgttgcggatcgtggctttcgcagccataaggacggggctgtcggtcatcgcatttgcgagtttgctcattgaatttccggttaaaggggcgatgaccatgcagtcgagcggaagtttcggcccgagtggctccgcttttacgatggaatcaatcgcctcaaagcctgttgtttcttcaatttttctgacccaatctcccccctccccaaagcgggtatcggtcgattgaacggttgatgtcacgaccggccggacttcagctccttgactgataagcgcctctatttgcggaaacacttcctcatatgtgcaatgcgagccggttaatccgaatccgattcttttccctttcagagacatggttatttcccctctttctttaagtctgccaaaagcttgctcaatacgttcgcaataatctgtccggctgttttcggggccacaattcccggaagacccggagcaagcagcgctttaatgccttgtttttcagcatatttgaaatccgttccgcccggacgggatgctaaatccaaaatcaaggtcttgggcgtcatgcgcgataaaacgctttgattcagaatcaagctcggtacggtgttaatgcagatatcaatatcatttacatgatcagtaagctcttcaagttgaaaaggagaaagccccatttccgatatacgggctaaatgagccgaactccgcgcgcccacttttactttcgcccctaacgctgcaaacgtccgggcgatcgtcataccggtgcgccccatgccaagaacggcgacatttgatccgtgaatggtataatccgtatgctgaatcgccatcatgattgttccttcaacagtgggaatcgagttgaatatcgcgatgtcgtcccgctcaaataatttcacaagcttacggccggcttcgctggcgatcccctcaagatacgcgttggagatgcctgaataaatgacgcaatgctccggtgtccgctcaagatagctctgctttaataccacttcttcatttgaaaaaaccgtggaaacaacgccttctccggtcgttgccgatacaggcaggatgatactgtctattttttgaaagggaatctcatcaattttgcatttgacggttcctgtaaaaccgtcatccaattggtcaaaccctgcaagataaatatcggcatgctgttctgtcagctttcttataatctcaagctgtcttgcgtcaccgccaatgatcgcaattgttaatccggttaacatctgaaacgttcaccttctttacagttactggatcctttaagtgtcatcctcctcttcatcgtatgtgcaaagagaaagggcggtgaatgtacagcgtctttttcataaaaaaagcaccggctgtatgagccggtgcttgcaaaaaatgaataagatctactcttcgggaggcgtgatctcccccggaacgtctaaaatgatcatgtctgacccgattttttggatatggttccaggggacgcggatgtcgtggccttgttttcgcagtccgaaccattttaccgtcggtatcaacagcgcggtaatttgtccgtcctgttcattaatttccaaatcggtctggccgagcacgccgagccgctctgcccgtttaatatccacaatttctttacctgacagttcactgagcctcatgatagccacccccttgtactatatgacccggagcaaaaaaaaatgcctgccccgtacagaggcagactgctttgcagcttaagacgaggccggtatattgccggtcgggctgatgagcgatagtgcgtaatcatccgtaaataagcggcggctgaggccgttgacgctttccaggctgaccgcatttaattcagcgataatttcatccatggtcttatgctttccgagcaggagttcatttttcccgttccggctcattttgctgtttgtgctttctaagctgagcattaagctccccttcatttgctctttgctgttttccagctctttcggggtgataccgtcacgttttagaaccgataacgtttcctgaatggtttcagacagaagtccgagctgattcgcgccggtgcctccgtaaatcgtcagcataccgctgtcttcataggaactgtgatagctgtatacagaataggccagtcctttatcttcgcgcacatcctggaaaagacggctgctcatgcttccgccaagcacgttgtttaagacgatcaaatcgtaaatgtccggatctccgactttcaggcctttgaaaccgagacagagatgcgcctgttcggtgtctttttttctcgtcagcttttcataatgaaactcaggctcgctgatgccgcttgctttgcccttcgcttcgtatgtaccgaaccatttctccacgtctttaatgaattgttccgttacatttccggcgacagaaatgacgacgcggtccggcgtgtaaaagtcatccatatgctgtctgagagaatcgccgttaaacgacgaaagcgtttcctccgtcccgagaatcgggtatccgagcgaatgattgccgtatgtcgctttgctcagcagatcgtggacaatgtcatccggtgcgtcttcatacattttgatttcttcatatacgacgttcttttcttttttgagctcatcttcgtcaaaagcagaatgaaagaacatatcagccagcacatcaagtgcgtagtttgcatgctcatccagcactttggcgtaatagcacgtatattcttttgaagtgaaggcattcacttggccgcctatccgatcgaaggattctgcgatttcacgtgcggacctggtatttgttcctttaaaaaacatatgctcaagaaagtgcgaaataccgtttgtctccggcgtttcatgacgtgatcccgtcccgatccatacgccgattgccacagaccgcaccgttggattattttcaagcacaactcttacaccgttttggcatgtatagcgttttatcaagtctgttcctcctattcaaagacaggcagctgcctgctacttcatcagcctgttttcatccattaagtcagacactgagccgagcgcgtagcctttttctttgatttttgcaatcagtgtatccaggcttttcgcagtcggatcagtcggatgcattaaaatcatggctccgttatgtattttgctcagcacccttgtttgtaaaacagcgggagacggtttttgccagtcaatggtgtcaacggtccacatgatggtgcccattcctttttccgccgcaaggtcgaccacggcttttctgaagctgccgcttggcggcgcaaaccatttcggcttcatgccgagcgtctcgctgatttgtgcattggttttgtcgagctgttcggaaatgcttcctgaagtcagtttgctcatatcagggtgattgtatgaatgatttccgatttcatgtccgtctgccgctatttttttccccagttcctgattgtttttcagccatttcccttcaagaaagaaagttgctttgacctggtgctgcttcagaataggcagcatttgctccacgtattcatttccccaggcgacatttatcaggaaagcgaccatcggtttgtcgggatttcctttataaatgggttcgggcgcgagagaatcaagatggactttcggctttacctgctcatagacaaggtcgtcttcgtgaaattctccgtcctttttcatttgtttataggatttttccacattgacttttaaaccgttatatcccggtatactcttccatattttatcaatccgagcgtcttgcggcttcacttcatactctgacgctttttgcagtaattcttcatagagcggatcttttgatgatgacacagttaccgcgtcttttttcattgcgtctatgtaatcaactgtatacgggttttttaacatttcaaacgaaacaaaaaaaagaaataaaaaaacggcaaacggcacgaattttttcaacatgtccttccccctcatcacacattatgtatgaggaggacaaggtagaacccgtctgttgtctttctcaaaataaagaagccgggtctcccaggctccttgttaggttttcatttaagattgttgttgttcctgttctttttctttctcttcgcgcagcactgctttacgcgacagattcactcgtccctgtttgtcaatttcagttaccttcacaaggatttcgtcaccgattttcacaacatcctcaaccttgccgacccgttcgagcgctagttcagagatgtgaacgagaccgtcttttccgctgaagatttcaacgaaagcgccaaatttctcaatccgtttcactttaccgaggtaaagctggccgacttcgacttctctgacaagatcttcgatgatttttttcgctttttggttgctgctttcatcagtagaagaaataaagatggtgccgtcttgttcaatgtcaattttaacaccggtatcttcaatgattttgttgatttgtttaccgctcggtccgataacgtcacggattttatccggattaatggtcatcgttaaaattttcggcgcatattgagaaagttcttttcttgattcaccaagcgtgctgagcatgctgtccaagatttccattcttccttttttcgcctgctgaagcgcttcttcaagaatttctcttgaaaggccttcaattttaatgtccatttgcagcgctgtcacgcctttttccgtgccggctactttaaagtccatgtcaccgagggcgtcttccatcccttgaatatccgtcaatactgtatagtactcgcctgatttcacaagtcccatcgcgatacctgcaacaggggctttaatcggaacacctgcgtccatcatggcaagcgtacttgcgcagatgctggcctgtgaagtggaaccgtttgattcaagcacttcagatacgaggcggaccgtatacgggaagtctttttcattcggaatgaccggctcaagcgcacgctctccaagagcaccgtgaccgatctcacggcgtcccggtccgcgcatcgggcctgtctcccctacgctgaactgcgggaagttataatgatgcataaagcgttttgactcttccacgcctaaaccgtcaagaatctgaacgtctccaagggcgcctaatgtacaaacgctgagcgcctgcgtctgtcctctcgtaaacagcccggatccgtgcgttctcggcagaagaccgacttctgaagaaagcgggcggatttgatcaacgccgcggccgtccggacggactttttcttctgtgatcaaacggcgcacttcgtttttcacgagtttagacagtgtctgtttcacttttttaattgtatcttcatcatgctcttcttcttcgaatttcgcgacaactgcatttttcacttcattgatcgcgtcttcgcgagcatgtttttcgtgaacctgaatggcgctgagaagatccggctccgcaaggctttttacttttgcgctgagctcttcgtcaatttcatacagttcgatctctgttttctctttgccgactgctgcgacgatttcttcttggaatgcgatcaggcgcttgatttcttcgtgaccgaacataatcgcctcaagcatgatttcttcaggaacttcatccgctccggcttccaccatgttgatggcatcttttgtgcctgcaacgatgaggttgatatcacttttttcaagctggtcaaccgtcggattgatgacgaatttcccgtcaatgcggcctaccgtcacacccgcgatcgggccttcaaacgggatatcggaaacgcaaagagcgagtgatgaaccgaacattgcagccatttcagatgagcagtcctgatcaacactcatgacaatgctgatgacctgtacttcgttacggaatccgtctgcgaaaagcgggcggatcggacggtcgatcagacggctggctaaaacggccttttcacttggacggccttctcttttaataaaaccgcccggaattttacctactgcgtataatctttcttcatagttaacggtaagcgggaaaaaatctagcggtttcggttcttttgatgcggttgctgtgctgagcactgcagtatcgccgtagcggaccatgacagcgccgtttgcctgtttggcaagctggccggcttctactgtaagctgtctgccggcccaatctatggtaaagacatgtttctcttgtcccattcgattacgagctcctctcttaatgtgtgaaataatcaattactcctattatgaacgaaatgaattgaacatatcaatgtcaaagtagtatgtaaaaggatttcattgtttttttattattatttttttcgctttaatacgataaaaaagcgggaatcctcccgctttttacgattatcgacgtaagcctagtttgttaattaactcacggtaacgagttacgtctttattacgcagatacgtaagaagattacgacgtttacctaccattttaagaagaccgcgacgtgagtggtgatctttcttgtgagtacgcaaatgctcgttcaagttgttaattgagtctgttaggatagcgatctgaacttctggagaaccagtatcagattcgtgtgttttgaactcgctgatgagttgatttttacgctcttgagtaattgccatcctgtttcacctccatatcataattagccccagttacctagcaaccgtcggtgacttcggattgccaagcaatggttttaagactacgaaacatatgatactaaaaatcgcgcccatatgcaaatcttttagaataaaatttgtgtacttttgatgttttttccgttatttgctgaaaaaacggatcgcttcttgtttgtctttcccgatctgagccgtcagttcatcgatgccgttaaacttccgttcgcttcggattcgtttgtaccactcgattttaacgtcttctccgtatacatcctgttgaaaattaaacaaatgaacttcaattgacggctgatcgggacgcttttcataaaaggtcggtttgtagccgatgttgcagacgccttcatacacctcgccttttatttcggctttcactgcatacacgcctgtcggcggcacgatatagctgttgtgcaggccgacattcgcggtcggaaaaccgatggtgcggcctctcttgtctccgtgaatcacagtgccccggagaaaatacggctggccgagaagagtgtgcgcaagttcaacgtcaccatcctggagcgctgaccggatataagtggagctgatctttctgtcctgctcggtctgtttctcgacagtcgtgcatccggccttgccgtttaaatcgtccggcagcgtctccatcgtgccttttccgtattttccgtacgtaaaatcgaagcctcccacagcgtgccgcgcgttcaaccctaaaatatactcctcggcaaactgttttggagacagagacgcaaacgcttcatcaaactttacgacatacagcacatcagcgcctaaacgtccgatctggctgattttatcttcaagcggcgtaatcagatcctttggctctttgtccctgcccaacacatgggaagggtggggatgaaacgtcataacggccagcgacaggcctttttcttcggcaatttgtctggctgttccgattactttccggtgtcccaaatgaacgccgtcaaagtagccgagcgccatgacagacgccggctgctcttctttttgtaaatgatgcggatgagaaatatgtatcgtcttcacagaacggtcaccttttttcttattgttcgcttttttgcatgagcactttagccggtttcagcagtcctttttttgaaggatgcggcatataaatggccacacattctccgtcttcagtacagaccgctatacgggcgtcagctgtcattgcagaaaattccgccgggatgtcaaacactgacccgttttcagctttcttagctaatgtatcacttatgacccatttcggcaaatgattgagcgctctatcgatcggcacggcatgctctgcaaccgttccgtccgaaacctgctgttcaagttcctcaaacgtgaaacactcatcaaggctgaaatcgccggaagcagtgcggatgagatgcgacatatgcgcgggatagccgagtttttcaccgattgtcaccgccaacgttctgacgtaagtgccttttgagcacgtgactgtaaagcggaatgatgctgtgtcttcgttataagtgacaggggaagtgagcgcgatatcttcaatcgtgatattccgcttcggccgctccacttcaatacccgctctggcgtattcatagagctttttcccgttgacctttaccgcggaatacatcggcggcacttgctcctgcggtcccttcaattcgtctaaaacggctttgatatccgcttcttccagcggctccctgacaggctttacgctgaccgtttctcccgtctgatcttcggtcgatgtggagaaaccgagagtgatctcagcatcgtacgtttttgacttgtcggtgacgtactcaacgatctttgtagcccgtccgacacagatcggcagtacgcctgacacttccggatcaagggttcccgtatgcccgactttctttgtttttaacagttttcttattttcattacacagtcgtgagaagtcatgccgaccggtttatgtaaaaggagaactccgttaaccatctgtctttcgctcctttgttatcaattgtatcccgtaaaacgcagaaaagaggacagacgacactcgcccatcctctttcccgttattcagacggtttatctgaatgcagttcgtgaatcaatgtttcaatacgattgccgtactcaattgattcatcaaattcaaattcaagctcaggcgttttgcggagtctgattcggctgccgatttcggaacggataaatcctttcgctttctcaagccctttcagcgcctcttctttctttttctctccgccgagaacggagatatacaccttcgctatttgcaaatcacctgaaacacgtacgtctgttacagtgagaaatccgattctcgggtctttcagctttcggctgataatatccccgagctcttttttcatctgctcgccgacacggtttgctctcatactcaattcaatcacctctaagttaaaaccactctgttctagtgatcgtccgttctatctcgggaaaggagtcaataaacgcgagtacgcgctggatctccttttccgcctgaacgtgagaggaagagacgacagcgattccgaagctggtccgctgccaagtgtcctgatagccgatttctgcggccgacacgttgaacttattctgaaccctcgttataatccgcttcagaacggctcgtttctcctttaatgatcccgcatcataaatgatgcattcacattccgcaaatccgatcactttctttcgatttcctgcatgacatacgcttcaaggacgtcgccttcgcgaatgtcattgtatttcttaatcgttataccacattcatatccttgtgaaacttctttcacatcatctttgaagcgtttcagaacgtctacttccccttcgaagatgaccacgccgtcacggatcaggcggagtccgctgtcacgtgtaatgtggccgtctgttacatatccgccggcaatcgtgccgattttcgacactttgaatgtttggcgcacttcaacctgaccgatgactttttcttcgtattcaggatcaagcattcctttcatcgccgcttcaatttcttcgatgactttgtaaatgatacggtgaagacggatatctacattttcagcttcagccgtgctcttagcatttccgtctgggcgcacattaaacccgataacgattgcatttgaagctgatgcgagaatgatgtctgattccgtaatcgcaccgacgcctgtgtgaatgattttcacttttacgccttctacttcaattttttgaagagcggctgttaacgcttcggctgaaccttgaacgtcagcttttacgattaaattgatgtctttaacatcgccttgtttaatttgttcaaacagatcatcgaggctcagcttcgctttgtcgctgcgctgttcttccagttgcttggaagcgcgtgcttcaccgacagaacgggctgttttttcatctttaaagacgaggaattgatcgccagcctgcggtacgtcgtttaagcccgtgatttctacaggtgtggacggtccggctgttttcacgcggcggccgagatcattgaccatggcccgcacgcggccgaatgtatttccgacaacgatcggatctccgacatgcaatgttcccgtttgaacgagaagtgttgcgacagatcctcttcctttatcgagctcagcttcaataaccgttccttttgcctgacggttcggattggctttcagctcttccacttcactgacaagcagaatcatttcgacaagctcgtcaattcccttgcctgtaagagcagacagaggaacgaaaatcgtttctcctccccatgcttcaggaacgagtccgtattcagtcagctcctgcatgacacggtcagggttcgcgctttctttatccactttattcacggcaacgataatcggaacctcagccgctttcgcatggttgatggcttcgactgtttgcggcataacgccgtcatcagccgctacgactaaaatggtaatatcagttacttccgcaccgcgcgcacgcattgttgtgaacgccgcgtgtcccggagtatctaagaacgtgatttttttgccgttttcttcgatctggtacgccccgatatgctgggtgattccgccggcttcaccttcaacaacctttgtttttctgatgctgtcaaggagggtcgttttcccgtggtcaacgtggcccatgatcgtcacgacaggcggacggatttgaagatcttcttctttgtcagcctcttcatatttttcaagctcagtttcttcaagcacaatcacttcttctgtttccacaccgtattcagatgcgatcagttcgattgtgtctttgtcaagctcctggttaatggtagccattacacccagaagcatcagttttttaatgagttcagacggttctttgccaagttcttcggctaaggccccgactgttaaagagccggaaaacgtaattttctcaggaagctcttttttcggcttcagcggtttttgctgatactgatttttgttgttatgattgcgtttgtttttgtttttgttgttgttgttattcttcttgtttttgttaaattgattattctgcacgtcattcttctttccgtctcgaattttgtttggttgattcccagcaggctgctgattaatcccttgcggcttgtttttgttcgtttccgcaggcttctgagatgtaacgccggcgccgccttttttaaatttcgcatcaagctgcttaatggtcttttcttcaagcattgccatatggttatttactactatatccatgtttttcagcgcagtcaaaatttccttgcttgaaacattgatggcttttgcatattcgtaaactctcattttagccattcgttcacccccaaaaatattaatcgagcaagctgatcagcttattcgcaaaaccttggtcagtgacggcgacaacgacacgtgattccttgccgatagagcggccgagatccgcgcggctttcgacttttttataaggcactttataataattgcatttatcggatactttttttgcagtattcgcagatgcatcttctgtcagcagaacaagttttgcacgcgcatttctaatttcttttataaccaagtcctcgcccgacacgaccttacgagctcgattggccagacccagcaagggaaaccattccattccagacatgttattttttcaccttttccgccagttccagcaattcttcgaaaatctggtcatcgatttgtgattgaaattgattttgcaatgtgtttttctttttcgcagctaagatgcattctttctcaagggtgatataggcaccccgcccgttcttctttccggtcggatcgactgaaatctctccttctttagaacggacaattcggatcagttcctttttaggcttcatttcccccgttaccacgcatttgcgcagaggaattttttttcgcttattcacctaaagtcacctcttattcatccgattcggctgtttcaggctccataaagagcggctctaaatcgtcatcttcttcatgctctctcggatagatgccaaggtctcttgcatccgtttcacttttgatatcgattttccagcctgtcagtttcgcggctaagcgggcgttttgccctctttttccgattgccagagaaagctggtaatcaggaacgatgacagtcgtggctttttcttcttcgctgacgatgacatccagtactttagacgggctgagcgcattggcaacaaattcaaccggatcatcagaccagttgacgatatcaattttttcgcctttcagttcattgacgatcgcctgcacccgctggcctttaggaccgacgcatgaaccgaccggatcaacgtcagggtcatcagtgcggacggagattttagagcggtcgcccgcttctctggcaacggatttcagttcgaccgttccgtcataaatttccggcacttcgatttcaaaaagacgcttcaacagaccaggatgcgttcttgatacatagatctgcggcccttttgtcgttttttcgacttttgtgataaatactttaatccgatcgtgcggtttatagctctcattcggcatttgttcattgacgggcagcagcgcttcaatcttgccgagagacacgtaaataaacttgctgtctaagcgctgtacaattcccgtcatgatgtcttcttcacgatcgataaattctgagtaaatcacgccgcgctcagcttcacggacacgctgcgtcaccacttgtttcgccgtctgcgcagcaatgcggccgaagtctttcggcgttacttctatttcaacgacatctccgacaaggtagttcggatggatgtgctgggcgtcgtcaagcgagatttcaagtcttgaatcgtatacctcgtctacgacatcctttcttgcgaacacgcgaatcgtgcccgtctcacggttcagatcgacccgtacgttttgcgcctggttaaaatttcgcttatacgcggaaattaaggcagcttcaattgcttcgatgataatgtctttactgatgcctttttctttttcaagaatagtgagagcatctaatagttcactgctcatgttagcggtctccccccttaaacactaatacttcattcattaaaatgttacagctaatcttgcgttagctattttttcatacggaatattgacccgtttctttcttgttttgaccgtcatctctattgtaacagtttgtccatcaaattcagccaatttgccttcaaacacttttaaaccgtcaatcggttcgtacgttttcatgtacacatttttgcccagtgatttttcgaagtcggcttttttctttaatggacgctcggctccaggagaagatacttcaagaaagtagttctgagtgatcggatcggcctcatccagcttttcgcttaacgcttcgctgactttggcgcactcctcaatatcaacaccgttatcggaatcaataaacacgcgaaggaaccagttttgaccctctttgacaaattcaatgtctacgagttcaagctgaaggtcatccagtatgggctgagccattccttgaacggtatcagtcacttttttgctcatgtttttcctccttgtgctgtcgatatcatatcagccgttcctctgcataaaaaccctgcttcaaaagagcaggggcattgagaaaacgatggacatgtcgaggcaaaattgcctgttcaatacaaaagagcgggtttccccactctttgcctcggtaatcgttagcatttccaataaaactataccataaccatatatttaatgcaaatcaaactccgctcggaggctgtgcacaaagcttaaaacagagacagctgattttggtccggaagcgactcaagacagccgtgacggtctaaatactctaaaatggtttttgacacttttcctcgtttttgaagatcctcttttgaaaggaactccccttcttcccgtgctttcacaatattgagagcggcgttggttccgagtcccggaattgagttgaacggcgggatgagactgttgccgtcaatgataaattccgaagcgctcgaacggtatagatcgaccttctggaaggaatagccgcgctcacacatttcaagcgcaagctctaacacggtaaggaggtttttctccttcggcgaagcatcaagccctttagagctgatatcatccatcaccgctctgatggcggtcgagcctttaatcattgtatcaatgtcaaagtcatctgcgcggacggtaaaatacgcagcataatataaaagcgcgtgatgcactttaaaataggcaatccgcaccgccatcagcacgtatgcggcggcgtgggctttcgggaacatgtatttgatttttttgcatgaatcaatataccagttcggcacattgttctttttcatttcttcttcccattccggcgtcaggcctttgcctttacgcacgaattccatgattttaaaggccagtgaaggctcaaggccctgataaatcaagtaaaccataatgtcatcacggcagccgatcacttcgctcagttcacacgtattgttgtgtatcagttcctgcgcgttgccgagccatacgtccgtgccgtgggaaagcccggaaatctggacaagctcggagaacgtcgtcggcttcgtatcctcaagcatctgccgcacaaatcgcgtcccgaattcaggaataccgagcgtccccgttttacagccgatctgctcttcagtgacgccgagcgattctgtaccttggaaaatcttcataacttccggatcatctgtcggaatcgtcttcggatcaattccgcttaaatcctggagcatccggatgactgtcgggtcatcgtgccccaatatatcaagcttcagcaggttgtcatgaatggagtggaagtcaaaatgagtcgttttccattcagaccccgtcgcatctgccgggaattgtatcggggaaaaatcgtaaatatccatgtaatccgggacaacgataatccccccgggtgctggccggtcgttctcttaacgccggtgcagccctgcaccagacggtcgatctccgcgccgcgcatgtgtaggttgtgatcacccgcatagcctttcacatatccgtaagccgtcttttccgcaacggtgccgatcgttcccgcgcgatacacgttatcttcaccgaacagcactttcgtgtagttatgggcatggggctgatactcacctgagaagttcaagtcgatatcgggtactttgtcacctttaaagcctaagaacgtttcaaacgggatatcatgcccgtcctttttcaaaggtgtgccgcaagacgggcagcttttatccggaaggtcaaaaccggaaccgactgatccgtcattaaagaattccgaatatcggcagctcgggcacacatagtgcggagcgagcggattcacttcagtaatttccgttaaggtcgccacaagcgatgaaccgacggacccccgggagccgacgagataaccgtcatccagagaccgttttacaagcttatgggagatgagataaataacggcgaatccatgaccgatgatgctttttaattctttttctattctcgcttccacaatttcaggaagctcttcaccgtaaatgcttctggcgcgctgatagctcatttcacggatttcttcatcggctccgtcaattttcggcgtgtacagatcgtctttgatcggtttgatctcattgatcatcgaagcgactttctgcgtattgtcaaccacaatttctttcgctttttccgcaccgagaaaggagaaagcatccagcatttcatctgtcgttctgaagtgcactttaggcagttcgtgcctgtttaacgggttggcgccgccttgggaagatattaagatcttccggtaaattttgtcctcatcgtttaaatagtgaacatttccggtggcaacgaccggcttattcaatttttccccgagcttcgtgatgttggcgatgatttctttcagcgctttttcatcccggacgagctcaagctgcagaaggtgtctgtatacttccggcggctgcacttcaagataatcatagaatgatgcgatatcttcaacctcttcaggtgatttttgcatcatgccttcaaagacctctcccctgtcacaggcagagccgattaacagaccttctctgtatttattaagctgcgacctcggaatgcgcggcactctgtagaaatattgaatatgagaaatagacacgagcttaaacagatttttaaggccggtctcatttacggcaagcaatgtagcgtgataaggccttgatctttgataagcattggattgtcccatattctcattcagctgatcatgataaaaaatgtctttttcagcggcatctttgagcattttcaacagcaggtagcccgttgcttcagcgtcaaagaccgctcggtgatgctgggttaattcgatatcaaacttcttacataacgtatttaagcggtgatttttaaactcaggatacaggaaacgcgcgagttccagcgtatcaatgactggatttttcgctttttccgttttcagtagacgcttgtacgccacatttaaaaatcccatatcaaagctggcgttatgagccacaagcacgtcatcgccgatccattctttaaaatcccggacgacgtcaacgacatcgggagcgtcgcggaccatgtcatccgtaatcccggtaagctctatcgtcgttgctgacagcggatggtgcggattggcgaacgcttcgaatttatcgatgatttctccgcctcttattttgactgcggcaagctcaatgatggtgtcatacactgcggacagacctgtcgtttcaacgtcaaagacgacgtatgtgtcttcttccaaaagacggtgagctggattgtatgcgatcggaacaccgtcatccacgatattggcttccattccgtaaatcattttaatgccgtgttttttcgcggcggaataggcatccgggaaagactgcacaacggcatgatcagttaacgcaatcgcttcatgtccccattttttcgcctgttcgacaagctttccgatgcccgttacagcatccatttggctcatcggagaatgcagatgaagctcaacccgtttttcgccttcaggagcggtgtcttcacgggttttggcttttatttcattcacgtcatttgcaatcatgacgaggtctctgacgaatgtatcgttttgaatgcttccccgcgccttcacccacatgccttttttcagcgttttcatcaaagcggcgtcttctttttctctggcgaacatttttactaaaatactgtttgtatagtccgtgattttgaaaatgcagagcgtgcgtccgcttttcagctcgcgtgtttcagcatcaaacacaaacccctgcaccgtgattcttctttcttcatccatgatgctgtcaagcgtccggatttcttcgttctctttaatttgatagccgatgacaagcgggccggacggcgcttgatcctcatcgccctctttttccttcttctccatttcgataagcgcctgcatcgcccgctcctgatcttcagcaagcttttgctcgcggaatttctggacttcttggtcagatacgaaaatttcggtatccagctgcagttccggaaatccgaattggcgatagctgtgctgaatcagtgcgctgtatttatttttgagcgccgatgcttctgtatctgtttttgttttcacgatcagtttgtttcccttgagcttcggcttctgctgattcaaaagagccaccatcggcggcgaggttccttcaagctcttcaatacagcgtgtccaataatcctgtacaagctcctctgtcactgtaggatcgatgacctgaacagacgatgtgacacgggcgatgtgagcaaacgattgtgttaacctcatcatgaatgaatcgtatatttgatacggcaaaagagccttaaagcgaaattggaaatgccaggctttttctgctttatggattgtcagtttatcaatctctccgtcttcaaagtatgtcatgaaggtatcatctgtcatattaagctgctgcagaagaatctgaaactgtcttctgtttactgataactgttccattcagacagtatccctcccttaaaacatcataagtgaaggtacctccgcaggtgatgaggtaccttcttttttctctattttaacatgattttgtacgattcgttatggtgattacttcgtcttaataaattcagaaagctcatccactgaaacttcagcagattcaccggttttgcggattttcacttctacgatgccttcgtcggcacgttttccgacagtgatgcggatcggaaggccgatcagatcagaatcagcaaacttcacgcctgcgcgttcagcgcggtcatcgtataaaacctcataaccttccgtctggaattttccgtaaagctgttcagcaagctctttttgcgcttcatttttcatattcagcgccaaaatatgaagatcatacggagcaacgctcttcggccagatcaagcctttttcgtcgtgatgctgttcagcgatggcagaaagcgttctggacacgccgattccgtaacatcccatcagcatcggctgcgcacgcccgttttcatcaaggtatgtcgcattcatcgcttcagagtaacgcgtgccgagtttaaagacttgtccgacctcaatcccttcagcgaaacggatcgtgccttttccgtcaggtgacggatcgccttcctgaatgattcgaagatcggcatacgcttttacagacgcgtcacgttcgatgtttacgtttcggtaatgacggtctttttcattcgcgccgcaaacggcgtttaccattactttcacggcttggtcggcataaatctcaatgtcgccggcagcgccgatcggccccgcaaatcccggctccgtgccaagtttctccgctacttcttcatgagacgcaagctcaaccacttccgcgttcagaaggtttttcactttcacgtcgttgacctcatgatcgcctcttactaacacgagaacaaatcggtcatccgctttaaacagcattgatttgatgcaggcgctcggctcgatctgcaagaacgaagcgagctcttcaatgcttttgacatttggcgtatcaattttctccaatgcctcgggtgtttcatctgacggctcgctgttcatgacaactttcgccatttccgtattggctgcgtaagaggatccatcggaataagcgatggtatcttccctatttcagaaagagccataaattcatgcgtgtcttttccgcccatcgcgcctgagtcggcaataacgggacggacgtttaattcacagcgtgcgaaaatgctgctgtatgcgccgtacatgttttggtacgtttcctccagactttcttcagaagcatggaaagaatacgcatctttcatgatgaattcgcgtccgcgcaataacccgaaacgcgggcgtttttcatctctgaatttagactggatctggtaaagagtgagcggcagacgcttataagatttcacctcatcacgcacgagagaagtaatgacttcttcatgtgtcgcgcctaaagcaaattcacggccgtggcggtctttcagacgcattaattcaggcccgtacgtataccatctgcctgattcctgccatgtttcagcctgctgaagggccggcatcagcatttccaccgcgttgattttttccatttcttcacgcacgatcttctgaatgttttgaatgaccctgtaagccaggggcatgtagctgtaaaccccgctcgtattttgtctgataaatcccgctctcagcagaagcttatggctttttgcttcagcatcagccggcacttctctcagggtcggaataagcgtcaaactttgtctcatgtcttcgcacctctgattttttactagtcaattataagaataaacgctggatatcgttccatgtgacaaccagcataagaagcattaagaaagctacgccgataaatacgacaaatgcttccttgtcacggtttatcggcttgccgcggattgcttcaatgaataaaaacagcagccgtccgccgtcaagcgccggtatcggcagcaggttgacgattcccaggttgatgcttaaaaacgccgcaaactggaataggttgataataccggtttttgcaacttgatccgtcatatcataaatgccgacaggacccgaaagcatatcaagcttaaactggcctgtcacaagtttgctcagattggtcaggatcgcttttgtgacatcaacggtagatgtcgcgccgtaagcaatcgctgcaagcgctcctttttcagtcggcgcataagagccgaagcggccgattgtttttttattttcatcttttacagcttcaggtgtaaccgagatatgaaacgatttgccgtcccgtttgacggcgacatcgatttttttcccgggattttcttttaccgctgtcacgatgtcggtccatgacctcattttttcaccgttaatgctctggatatagtcgccttcttttaaaccggcagcagctgcgcgtccattgtctgtcagcttcccgagctcaggctgatttgaaggcacgccttgaatgaatccgagcatgacgagaatgacatacgctaagatgaagttcattatcggaccggcagcaatcgccttaatccgcttccatacgggtttagacccgaattgtcgattgtaaggcgcaatctgcacttcttctccgtctacgataaaaaaagaggtctgactgacagtaaagcccgccagttcatcttctttcccctgctcgtacccggtaatcttcatttcgtgctcaagatcagccgtctccacctcgataattaaagcgtcgggatatttttccttttgattaatgatgactttttccacttcgtcatctttattaaaaagaagcccgacggtataaccgggtttgacttcgatcatctccgggtcttcaccggccatgcggacgaaccctccgaccggaaggagtctgatcgtatacacggtttcattctttttaaatgaaaagattttagggccgaagccgatcgcaaattcacggcaaaggattcccgctctttgggcgagcaataaatgcccgagctcatggaaaaaaacgagcgttccgaaaataataataaacgcgataactgtattcacgaacataccaccttatgtgagtattgaattaacgtatccccgggtgtctttgtccacttcttggatatccgcaagactcggatcctgaattacgctgtggcggtccaatgctttttcaatcaggtcctcaatcgataagaatgaaatccgtccggcaagaaaagcggcaacggcttcttcgttggccgcatttaaaaccgtcggcatcgttccccctattttacctgattcaaaggcaaattgtaagcagcggaacctttcaaagtcagctttcgcaaaatgaaggcttccgatctcccataattcaagcctttttgtttcaggcagaggcagccggtccggatatgtcagcgcgtattgaatcggcaccctcatgtccggatttccgagctgggcgatgacgcttctgtcgtgaaattcaaccatcgaatgaatgatgctctctttatgtaatacaacgtcaatctgttcatacggaatgtcaaacagccaatgcgcttcaatgacttcaagccctttattcatcattgtagccgagtcaatcgtaatctttgcacccatcgaccagttcgggtgattaagggcgtcggcaatcgttacagactcaagctcctgccgcgttttatccctgaaactgccgccggatgccgtaatgatcaggcgctcgatatttttgctctgttcgccttgcagcgcctgaaaaatagcggaatgttcgctgtcaaccggaagaagaggaacaccgtatcgttttgcgtgtcctttcactatatgcccggcagtgacgagagtttccttatttgcaagcgcaattgtttttttctgttcaatcgctttcaaagtcgggattaaaccgacgcttccaagcagcgcattgaccacgatatccacttcgtccatgactgccgcttcaatcaggccttcttctccgatgccgatttgacattcatgcgaaaaagacgcttctttcactttttgatatgtatccatgtcgccgactgctacatatttcggctgaaacgttctgatcaacgggatcgctttctcggcgtttttaccgaaagtcatcgagacgagacggaactgatcttgatgcatgcgcaatacgtctaacgtctgctccccgattgatcctgttgctcctaaaagacaaatattcttcaaaatgccactcccattctatgcgtccagatcggtcttattttcatattagcctttctcatgaaaaaagcgcaagcagaaagtataagaacggcatgacaaacaaaaagctgtcaaatcggtctaaaatgccgccgtgcccgggaaggattttccccgaatccttcacatcatagtgccgcttaagcgctgattcaaccaaatccccgatctgtccgaacacagacagaacaagcgtgatgaccaaaagaaccggatatgaaatcggaaggtgagcaaacagctgaaaaacggccgtaaaaataagggcgatgacaataccgccgagaaacccttccactgttttgttgggactgatttcgggccacagcttccgcttcccgagcgactttccgacgaaatatgcgcctgagtccgttgaccatatgacaacgcaggcataaaagatatacaaaagcccgtttgtttcaatgtttctgatttcaataaaataatgaaaacacagtccgatatataccgtcgcgagaacgataaacccgacttcgtcaaacgtaaaggtgtttttcacgagcaccgtatagctgagcagaatcaatacggcgaaaatcgttacttccattttcgcatcgaaaaaatgatatttgtccggcatcatatacagccataacaacaagaagctgatcagacccggaaaagaaaaaaatctgagctttttcatccgcaaaagctcaaaaagcgctatacttcccatcacgtaaacaaatacggtgaacggcaatcctccgaaaataaccaaaaataaaaatagtgccgctgccagaacacctgttaacagtctttgtttcatttccaccatcctctaaattccgccaaacctccggccccgctgctgaaattctcccactgcctgcagaaagtgatcttctttaaaatcgggccacaggacatctgtaaaaacaaattcactgtaagccacctgccaaagcataaagttgctcagtctgatttctccgctcgttctgatgagcagttccgggtcctggattgattctgtcattaaatgcccggaaaagagcgcttcatcaatgtcttcgatattcagcgtgccgcttttcacctgttcggccaatgcttttgccgcattgacgatttccgtgcgtccgccgtagttcaaagcgaaattgagaatcagcccgtcattttgttctgtatcttttacggccttctcaatcgccctgtacgtatgagaagggagcgcggattcatctccgataattttcacctgtacattttcctctatcaattcaggaagatacgtattcaggaactcttccggaagcttcatcaaaaagtcgacttccatcttcggtcgcttccaattctccgttgaaaacgcataaagagtcagaactttaacgccgagctgatttgcgagctttgtcaccctttttaccactttcattccttcatgatgtccggcaatccgcgggagtgagcgcttcttcgcccagcgtccgtttccgtccataataatggcaatgtgtgcgggaatttcacccttcagtatgtcttcttttgtataccgttctaagttggaagccgcattctgctgattcttccaatttttgagtatgttgagcatgagattcctccgtcacccaaaaaggttgcgttgctgatgatcaatgtaatcaacagtattaacaaaaaaaccccctgtaaacatgagagggtcttttcacattatctattgtacatagtttttcattaaacttccatgatttctttttctttgtctttcgtgacgctgtcaatttttgacacatattcatctgtcagcttttgaacgtcttcactggaagcacgaagctcgtcttctgtaatgtccccgtttttctcaagttttttgaggtcgtcgttgctgtcacggcggacattacggactgctactttcgcttcttccgcgtattttttcacgactttgacaagttctttacgtctttcttccgtcagagccgggatcgcgatgcgaataattgtgccgtcacttgtcggagttacgccaaggtcagctttcaggatcgctttttcaatatcgccgattgccgttttgtcatacggtgtgacaacaagcatacgcgcttcaggcacattgatggaagacagctggtttaaaggtgtttgggcaccgtagtattctactgtcactttatccaatagagatgggttggcacgtcccgcgcggactgacgccaattcacgtgaataagcggcaaccgctttttccatgcgttcttttgtttgtgttaatacttcgtttgacaacgttatttcccccttacgatcgttccgattgattcgccgattacggcacgcttaatatttccttcttccataatagaaaagacgatcagcggaatatcattatccatacatagtgaagaagccgtagaatccatgacttccagcccgtcttttaacacatcgagataagataatttttcgtatttaacagctgactcatcttttctcggatcggcattatacacaccgtcgacattatttttcgccattaaaatcacatccgcttcgatttcagcggcacgcagcgctgcggttgtgtccgtagagaaataagggtttcccgttcccgcggcaaaaatcacaacgcgttttttctccaggtggcggatggcttttcttctgatataaggctcagcgacctgacgcatttcaattgatgtctgcactctggactgaattccgagcgtttccaggctgtcctgcagggcaagtgagttcatgacagtagcaagcatgcccatataatcggccgtcgcacggtccattcctaagtcactgcctgtttttccgcgccataagttgccgccgcctacaactacggccacttcgacgtcaagctcagcgatttcttttacctgtttagcgatggattggataacagtcggattaatgccgtttccctgctctcctgccaatgcttctccgctaagctttaaaacgatacgattgtattttggtttttccataataacctccaagtgtaaacattgccgtttcctattatgcaagagaaaaaaaggtttgtaaatatagttttaaaaatagggaacacaagtagtgtcccctatactgcctgaaaagccgcgaaagattcgccaaggctttccgccattattttttcacttggttcataacttcttcagcaaagttttcttggcgtttttcaatgccttctccaacttcgtagcggacgtaagttttaacagatgcgtttttcgcagccacaacttgtttcactttttcgtctgggtttttaacgaaagcttggtctaataagcaaatttcttcgaagaatttgttcagacggccttcaaccattttagctacgatgttttccggtttgccttcttgaagagcttgctgagtcaggatctgacgctcatggtttgcttcttcttcagacacttggtcgcgggaaatataacgaggatttaccgctgcaacatgcatcgcgatgtcttttgcaagatcttcgtcagttgttccgctaagaacggataatacgccgatgcggcctcccatgtgaaggtaagcaccgaacgcttcgctgtcttcttttgtaagaacagcaaaacggcgaagagtgattttctctccgattttagcaacattgcttgtgatgtattcttcaacagtagaaccgttttccatcttttgacccaacgcttcttcaagatcagcaggagcgtttgcaagaaggtggtcagcaagcgtgttcagaagctctttgaagccttcgtttttcgcaacgaaatcagtttcagagtttacttctaagataacgcctttgttgccgtcagttttaataagagtagaaccttcagcagcgatacggtcagcttttttagccgctttcgcaattcctttttctctcagaaggtcgattgctttgtccatatctccgtcagtttcagtcaatgcttttttacagtccatcataccagcgcctgttttttgacgcagttcttttacctgctgtgcagtaatagccatttgaattcctccttatatgtgtaaacaagatatgtatagatacatttttcttgaaaaaaggtgataaaaggcagtccctcttatcaccttttgattaggttacgcagttgtcgtttctgtttcaggtgcagtctcttcagcagcttccgcttcttcttcgccttgcttcgcttcaagaatggcatctgccattttagaagtaagaagtttgacagcgcggattgcgtcatcgtttgcagggattacgacatcaatttcatcaggatcacagtttgtatctacgattccgatgataggaatgttcaatttgcgagcttccgcaacagcgatgcgctctttgcgaggatcgatgatgaataatgcatcaggaagatccttcatgtctttaattccgccgaggaatttttcaagacgctctaattcttttttcaattgaacaacttcttttttcggaagtacttcaaatgtaccgttttcttgcattttctcgatgtctttcagacgcttaatgcgtttttggattgtttcgaagtttgtcagtgtaccgcccaaccagcgttggttgacatagtacatgccagagcgtacagcttcttctttaacagaatcctgagcttgtttttttgtgccgacgaaaaggatttttccgccttcagcagcaaggtttttcgtgaagttgtaagcttcctctacttttttcactgttttttgaaggtcaatgatgtagattccgttacgctccgtgaaaatgtaacgcttcatttttgggttccagcggcgtgtttggtggccgaagtgaacaccagcttcaagcaattgtttcatagaaataactgacatgtgatttcctcctaataaaatggtttttttcctccgcttaggtcatttttgtgcagaactgccgtttgcagcaccctctgcataaatcgttaagcgtgtgtatttaacaccaagacataatataacacagctttatgcgacaatcaagaatcctttacagctttgccgcgaaattttaaaaacagctcgatttctgtctttccgctctgcacccgtttggcgatttccgcaggggtgagcccttgttcatataattctgaaacacgttcttcaaacgaatgcgcaccgttgttttcgtcactttcagcccgttccgttgcactgatgagcttttccatgtgatccggaatatcaggctcttttttcggttccggccggggttcggcgtcttctgcgtcaggcgcttgatcattccggctttttgtgtcttcgagtctttcattttcttctttcagctcaagcagaaacgctgcaagggtgttttccgtctcttcaagaatcttcttctgctggcgctccgtctccttgagggctgaaaacctcgtgtacagaataatgacggcataaagcagtacgccgtgaagcacaaagcttaaaagccataatagtgttgacatgtttttcactcgctaaccatgagttcattattgaattactttttcaagcaggtgctttaatttaaacagcgcctttgaatgaatctgtgaaatccgcgacgtcgaaaggttcaggacttgtccgatttcggtcaaagtcagttcttctttatagaataaactgacgacaagctgctctttttcagagagctcgtgaattttgcccgcaagctgagcgatcagctcgtccttcatgattttttcttccggcggcacatttttgtcatctctgatcatcacttgaatattctcaccgtcatcctggtcgtgaagcttttcatcaattgataagagattggcaaaaaacccttcattcatcgttgatactacgtcctgctccgtcatcccaagctcttctgcgatctctgaaggcgtcacattccgaaggtagcgctgttcaagtttttcgattgccgcttcgactttttttgtcttctcccgtgaagttctgggcagccaatcttctttacgcagcccgtcgatgattgcaccgcgaattctaaacgaggcataggtatcaaattttaaatcccggccggggtcaaatttttctagggcatcatataaaccaagcataccaaggctcattagatcgtctttatgcaccgatttcggcagtccgacggaaattctgccgacatgatatgtgaccaaaggcatgtaacggcgcattaaatcatcaccggctttaggatctttccactctttccagcgcgaccaaagcacctgatcttcataattcaaggattgcattgttatccccctacctcatacctttattaaatcgttgtttcaccttgtttaacagttcgaatgtgcagcatgcaggactttggctcaaattcaatcgtccggccgcttgagccgcccgtatcttcactgatgaccggaatgttatacaatgaaagctgctctttgatagccgctacattcctcggaccgattttcatcaggtcgtttgtcattttaaacttaaacatctccgctcccccggcgagttttgccttcagggcaaacttgcggcagccggctttcaaaagcatatcaattgtcatcttaacggcggtgtccgcgtattttgcacggttgagctccgccgtttttgataaaccggagtccggcagcatgacgtgaacgagtcctgccgtttgtttgtctttatcgtataaaaccagccccacgcatgaaccgagtcccgaagtccggattttatccggataacgcgcgacttgaacatccgcaatccccactttaacgactgcggcttccgcacggctcataaagccgcacccaatgagacgaagagcttttcaaaagaatcatagtccgggagcataaacatatgggctttgagctcctgccggctgccctggtcaaaaatagaagtatccacgacaatggcatgctctccgacttggctgagctccatcagtccttcactgataaccgcgccgaacatatcaagtgagatttccggcacgctcgggtaaatctcaagctttgtcaaatcagccaatgccgttaaataggaacctgctaaaatattgccgaactcatgtaaagcagaagaactcaaatgatcttcgcccaactggtcaatatcaaaatccggatttccgatcagctctctgataaactgttccgcctgatggaaaggcatgatgagaaagatagagcctgtcatgtcgccttccattcttaaaaagatactggcgaccggcgtttcagccccgccgaaaaaatcagcgagctcatcaaatgtcaataaagtcgcaaacggcacttccatgtctatctttctgttcagcagctgagccatggcagaagccgagtgacccgccccgatatttccgacttcccgcaaaatatccatctgctcttctttgatcgcttcaaacttactcatgttgtcttttcccctttaagcattcggctctccggacgcagatgccgaagcacctttatccagcaccgcatgcgcatcaataatattgaggagcctgttatcttgcttgacgatctgtttaatccacacatccgtttcctttgtctggctttcaggcgcggattcgatttcattttcatgcacggtgatgacgtcattggcctcatccacgacccatccgacatcggcgtcacggtaagaaatgatgataatccgtgtctcttctgtgatgtcctgttcaggctggttcagacgttttcttaaatcaagaaccggggtaattactccgcgcagattgataacgccgcggatatacgattccacacccgggaccctcgtcggtttttgccacttttcaattgatttcacctgggaaactgagatagcgtattctttcccgtttatcataaacacaatcattttttcacctgttttgatttcagcagtcatgcgggcacctcctcgtgtcgttttagtagatcagcgcattgcaatcaataatcagcgccacttctccgtttccgagaatcgtagcgccggaaatcgcaaagacgttcgtcaaatagtcgccgagtgatttcagtacgacttcctgctgtccgataaaagagtccacgacaaaagcagtggatttatcgccctttttcacgacgattacatggaactgatcggcatcctgttttgaatctgtaatgccgaattcttttttgagatagacgatcggaacgatttgtcctctgaaatcaatcacttctctgtcatgcgtctgcaggatatctttcttatcaataacagccgtctctataatagaagaaatcggtatcgcaaacgtctcttcttccagtttaatgagaagaacggatataattgaaagtgtcagcggaagctggatactgaaaagagaaccttggccttccgcggatttgacactgacagagccgccgagtgattcgagtttattttttacgacatccagaccgacgccccgacctgaaatgtcagaaatttgatcggcagtcgagaagccaggagcaaaaataagctcgtaaatctcattatcttcaagcgtttcagcatcacgttcggtaattacactccgctcgagcgctttttcaagaattttctttctgttcaggccggccccgtcatcttcaacttcaataaagacatgattgccgctgtgatatgccttaagcacgacatgacccgattccggttttcctttattcacccgcacttcaggcgattcaatgccgtgatcgatgctgtttctgattaaatggacaagcggatcgccgatttcatcaatcaccgtgcggtccagctccgtttcagctccgatgatggacaattcgattttcttgtttaattccttttgaagctggcggatcattctcgggaaacggttaaagacggtttctaccggcaccatccgcatattaagaataatagactgaaggtcgcccgaaattctggtcaggcgttcaacggtttcagtcagctcattgtggtcaagctctttggcgatctgctcaagacgtccgcggtcaatgacaagttcttcaaaaaggttcattgaagaatccagtctttcaatgttgacgcgaatcgttttcgagccgctgtgatgcttcggctgctcttccgttttcgcttgcggtttcggctgtttttcagcctttttaaccggagtttccttcaccggttcagctgcttgcggtttttcggccgtttttaacggcgcaccggcagaaatttcgacattctccacttctgaaatgccgctgatgagttctttaatttcttcagcaggctgctttgtcaagaaacacacctgaaaatccgttccgaaatcttccgtctcaagcacttccgcggcgggtatcgtttttgcaacttccccggcttcattcagcttttcaaatatcatgtacacgcgcacggctttgagcatgcagctttcattcagggaaaccgttatttcatagcggctgaatccttgctcttccgcctcttcaataacagtccgttcgaactcatcataattccattcagttgaagtctgttgttttgaagccggcggttctgctgtttcggctgaagccgcagtctcatgcgccgcatttacgtcgagcttcgcacttacttcagaaatatcacgtttgccgtctcctccgtcaataatggactgcaccatctcttcaagatgatcaagcgcttcaaacagcacgtccagccaatccgatgtaacgggcatttctccgttgcggatggcgtccagcacattttccatcaggtgggttaaatgcgccagatctgtatatcccatcgttgcgctcatgcctttcagcgtatgggcagctctgaagatgtcatgcacaagctgaaggtctgccggatctttttccaacagcagcagcttttcgttacatgtctgtaagtgctctttactttcatcaataaagacatctaaatattgattcatatccaattgattcacaccctctcttttttcacacatccggtgatggatgccgcgatatcttccacatgtttaatctcatgaatgaggcccgcctttatcgctgacttcggcattccaaacacaacacaggattcgtccgattccgcaatcgttttaacgccgcctgttctgagcatttcttttacgccctcggttccgtcgctgcccatgcctgtcataatgacggctaccttttcgtaaccggataaacggcttgccgaccgaaacaaataatcggctgacggtttatgccggctttccgtatcatgaacatcaagaatgatgcggagccttccgccttcctctgcaaccgtcatattttttccgccgggcgcgatgtacacccatccgtctttcgcttcttcaccgttttccgcttctttgacctgaatatctgacaaatggttgagtctgtctgcaagtgaagcggtgaagccttcaggcatgtgctgaacgacaaatacaggcgcctttaaatccttcggcagtttcggaaccaccttttgcagagcccgcggtccgcctgtagaggtcgcgatgaatacggcctgcttggcggattttgctttcggtctttcaaatcccgccaaagccggacgttccgggatagaagactctttcactgccgcctcaggtttttgtgcgcgggacatcccggctgcaatcaccctctcaatcagctgctctttaattttataaagatcaagtgaaatcgctccggaaggcttagtgataaaatcaaaagcgcccatttccaggcagttgatcgttcggtccttcccttgctgtgtctggctcgataccatgatgacgggaagtttatatatgctgatgatcttccgcaatgtatccgttccgttcatgaccggcatttcaatatcaagcgtgacaacatccggtttgagaagctctattttcttcagcgcctcttccccgtttctggctgtcccgatgacttctatctgcacttccgcagccagaaaatcggtaatcatctttctcataaaagctgagtcatcaacgacaagcacacgaatcactgtaaagtcctcctcaataaaaaagaagataatctctcaataaatgccggtttctcttctcttggtttgttttcttccgtttgaaacaagacatccgtcagaagacggacggacctgctggcttttgcttgaggactttttattaaaaaaggcacctggtcaatgacggcttgacttactagcggatcatcgggtatggagccggcgaaacgcacctccgcgcctaaaaacgtgtggatcgcatgagaaaggcggttgtacgtgtccagcgcctgtttttgagcgcgggcgcgattgacggcaatgtttacggtcagccgttcatccgcgagcaaaagatgtttgatcgcgctgtacgcatccataatggccgtcggctcaggcgttgtcacggcgagaatgtcttccgccgataaaataaacggcagctgttcttttgaaagtcccgctcccatatcaaacagaacgtaatcaaaatcgcttaatacagcggaaagaccattcataaaagccgaccacttctctctgtctgcttgatagaacgcctcaagccccgttcctccggatatgtagcgaaggcctttcggaccggaggaaagtgattgagccaacgcgtgccgattctccatcacatcaataatggtgcgggaagaagcagctccgatcagcacatcaatgttgcccattccgatgtcaagatcaatgatgagtgctttttttcctttttcctgcagggcaactgccatgtttaatgttaaattagattttccgacgccgcctttaccgcttatgacggctaatgtcctcgcttttttctcataaagctccggcttgatcatttgcctctctctcattttccttcttaatgactctgcctgatcgggtttcatgccaaaagcatccttacaaactcttttggtgaagccgataggatgtcttcaggcacatcctgtccatttgtcaaataggcggcgccgattcttgattccgacagcacttgaaacacggagccgagtgaggcggtttcatccgttttcgtgaaaatgaattgattgaccggcacaccggaaaactgtttcagcacctgtttcatatcttcatattttgcagatgccgataatacgagaaaggattgtaagcctgattcaaacggaatcatctcttgtaattccgtaatatactgctcttctttaaagtttctgccggctgtatcaatgaaaacatggtcgtattcagcgaatttttccagtgccttcagacattcttcctttgaatagcatacttcaagaggagcctgaagcagctccgcatatgtcttcagctgctcgaccgcggcaatccggtaagtatccgtcgtcataaaggcaatttttttatgctctgtcagcattgatgaggccgcaagtttcgcaagtgtagtcgttttgccggccccggttgaaccgaaaagcacgacgtattttgattgaatcccttcctgccacctgtctgtcgaagggagttttttcactaacaaatcctgcagctttgagctgacattatcttcagttaaatctccggaaacaattgaagaactgagcaattcactgagtacagcgttttgcgtatgatcaggaagcccggcttgcttcaatagtctctcggctttttttaatggttcagggagcacttctttcaaatgcgccagttcgccggaaatactttgatccggaaggcgcggcggctgaacaggctcagctttctccgccgtttccgtctttttcatttcttcagcggcagccggcggcgtttttctcgcttccctgacgtcacgatctaaaaccgctatcacttcgacggcctgctgcgaccgcagccccagccattttcgtttctttacttgtttggaatgtaaaataacggcatcattgccgagttcctttttgatttgcttcgcggcatcctgcattgaagcggctgtaaatttttttattttcattaaatatccaccactccaatgctctgtacttcaacatttgcttccagctcattataagaaagaaccggaagatcagggaaataccgttctaacagctgttttacatacattctgacagcaggcgagcaaagaagaatcgccgactcctgacggatggaaagctgctcggcctctttagcgacagaacggatgatgctgtccgaaacctcagggtcgagtgacaggtaattgccctgttcagtctgctgaaccccgtctgcaatcgctttttccacccggcctgagcatgtgatgaccttcagcgtttcatgctctctcgcatattgtgccgtgatttgtttggcaagcgactgtctcgcgtattctgtcaaaaggtctgaatctgtcgttaatcttccgtaatcggcaagagtttcaaaaatggtcaccaagtttctgattgaaactttttctctcagcaatttggcaagcaccttttgaatatcgccgacagaaagagggttcggcgtgacttcctcgacaagcacaggataattttccttcagatgatcgatcagctgctttgtttcctgtctgccgaccagttcatgagcatgctgcttaattttttctgtaatatgcgtagatacgactgacgccggatcaacaactgtataccccagcatgtccgcttcatcttttgcagcttcgctgatccattttgcgggaagtccgaacgacggttcaatcgtttcaattccttcaatgacgtcatcttcaggcgtcggtgacatcgctaaataatgatccagcaggagctctcctttagcgacttcattgcctttaattttcaatctgtattcattcggctggagtgcgatgttatccctgatgcgcacaaccggaatgacaagtcccaattcaagcgcaagctgacgtctgatcatgacgatgcggtcaagaagatcaccgccctgccccgcgtctgcaagcggcacgagtccgtatccgaactcaaattcaatcggatcaatatgtaaaagctgcacaacgctttccgggcttttcagttcatccgcctgagcctcttcttcaagaatttcttcctcttcttcgctcggcttatccgctttggacagcatataagcgccgaatgcaagcagaccggcgatcggccccgtcagcagaatgccgatcggtgtaagaagaccgagcaaaagtacagttcccgcggctacatacaagagcttcggataagcaaacagctggcctgtaatatcatgaccgaggtttccttcagatgccgctctcgtcacgacaatccccgtagccgttgaaatgagcaaggccggcatttgagaaacgataccgtcaccgaccgtcagcattgtaaagtgagacgcagcttcttgtatgctcatcccctgctgcagcatgccgattacgattccgaaaataatattgatcatcacgatgatgatccccgcgatggcatcccctttaacgaatttgctcgcaccgtccatggcgccgtaaaaatccgcttcccgggcgactttttcacgtctgtgctttgcatcctgctccgtaatcatgccggcatttaaatccgcgtctatactcatttgctttccgggcatcgcatcgagcgtaaatctcgccgccacttccgatacccgctcggcgccttttgtaatgacgataaactgaataataattaagataatgaagacaacaagccctaccagcacatttccgccgacaacgaaattcccgaatgtctcaacaacctttcccccttctccgtgagaaagaatcgaacgtgtcgtcgacacattgagcgcaagccgaaacagcgtcaataacagcagcaatgacgggaatatcgagaattgcagcggttcttgcatattcattgtggtgagaagcacgatcaacgcaagagagatattaatgatgatcaaaatacttaacaaccatggagggaatggaatcaccagcattgccacaatgaggacaacacttattaaaaccgataaatctcttgttgacatgctgtttttctctccttttgaatctgaaattcgctatactttttgtttcgttttatatacataagccaaaatttccgcaatgactttgaaaaactcttccggcacagcctggtcaatgtcaacctgatcatataacgcacgcgcgagcggcctgttttcaatcgtcatgacatcgtgttctttggcgatctgcctgatttttaatgcaagatggtcgacccctttggcaacaatgtaaggggcggccattttcttttcatcatattttaaagcaatcgcataatgggtcgggttggtaatgatgacatccgctttcggcacttcctgcatcatccgcctcatcgccatttcccgctgcttctgcttaattttggacttgataatcggatcaccctccgattttttgtattcatcttttatatcctgctttgacattctgatatttttctcatagtcaaaacgctgatataaataatcaagcccggccagcagcattagagcccctgatcccgcaagccccatccaaagcgtgagcttagaaacgaaagtgagcacttccgcaggtgttaaaagcggaaggcggagaatatcgccataatgcagccagagcaccataaaggcggcaaaaccgaccacagtaatcttcaaaatggatttgaccagttcaacaatcgccctcatgctgtaaatccgcttaaatcctttcagcgggctgagcttattcaagtcaggcttgagaacttccgcagaaaacagaaaacccacctgcatgtaattgctcacgacacctgccacaagcgcgaccagcataatcggcgcgaggatgaggctgatatctttcaccgtatctacgaacagttcatgcacggaagatgctgacagatgtaatgatatcgatttcgtataaaacgttttaataaaggacagcagcctgtcccgcatataaggaccgagcgcgatcagcgaaagaaagataatcagtaaagaaacggctgtattcacatccgtacttttcgcgacctgtcctttctttcttgtatccttccgttttttcggagtggctttctccgttttttcaccggcaaagaattgcagattcagtctgagtctcatcatgtcacaccgaccaatgccaatagattccgcatggtttcaacggtaaggctgaagatgttgcggacgacgacaaacatcaccgccatacaaacgatcagcataataaagctcacggctattttcagaggaagcccgacaacgaaaacattcagctgcggcaccgttctcgccacaataccgagcgccaaatcaactaaaaacagactggccacaaccggcgcagacatttgaaaagcgataatgaacatggcattgaagctttttgcgataaaaagtccaaagtgatcatttccaaacgacggaaatgcctgatcaagcgggatatactgaaagctgtaataaatcccgtccaataaaagataatgggcgtttacgctgagcataaataacagcgccagcgtataaacgaattgtccgatcagcgggctttgcgttcctgattgcggatcaatgacattggcgatggaaaagcccatctgaaaatcaataaaggaacccgctatctgaatggctgtcatcatcatgaaagcaatcagcccgaggctcaagcccacaacggcctcttttatgacaagcagcatatactgttcccctatttctatttccggcgcatgtttcagcgtgctgaagcagatcaccgaaagaaaaaaagcaaagccgattcggtgaaccgccggcagattccgatgtccgaacaccggcaccgttacaaaaaaagcagagattctgataaagaccaataaaaaagcgggaaataaatcaatgatggaattcatttgattctaccctgcaaatcggttcagatgagagaacagatcagttgtgaacgaaagaatcgtcgacagcatccaaggaccgaaaaagatcagtccaagcatcaccgccacgattttcggaatgaacgcaagcgtctgttcctggatttgagttgtcgcttgaaagatactgacgagcaaaccgacgatcagcgcgatggcaagcagcggcccgctgatcattagtgttacatatacggctttttccgccatggaaattacaaattctgaactcacaattagcacctaccctaaaagctgtcaagcaaagatttcacgattaaataccatccatcgaccaaaacgaaaagcaatattttaaagggcagagagatcataaccggcggtagcatcatcattcccattgacattaagacgctcgccacgaccatatcgataattaaaaacggaataaaaatcataaagcccatttgaaaagcggttttgagttctgatatcgcataagcaggcaccatcgtcgtcaaaggaatatcctgaatcgattcaggttttttcattttggcatagttcataaacagcgccagatccttctgccttgtatgcttgctcatatactctttaatcggcttctcggcttttgtatatgcttcatcgagactgattttgttgtccatcagcggcgttaaggcttccttattaatctctgaaaaagtcggcgccataataaaaaacgtcaagaacagcgcaaggccgattaaaacctggttcggaggcatgttctgcgtcgccagtgaggttctcacaaaagacagaacgatgacgattctcgtaaagcaggtcatcaaaatcagaatccccggcgctactgaaaagacagtcaaaagcagcagtaatttaacagtggagctgacttcggtcggattgcttgaattaaaaagattaacgaattcattcatgatgataagggcctttcttctttccttcagaacggctttgtttcagctcgttcagctgttctttcagcgcttttgaaaacgacggaagcatcgtttgcggctttttttctccatccttacgcggatttacgagcttggtccattccacttttgaagacatcgactcttcgtattggctcagaatcgcctcgcgctctttttcatcttctatttcttttaaaagctgtatcgtttcgcccacaccgactacgagaacgctgtttcccactttaatcagctgcacggaacgattttggccgactgacgttccgccgatattttctacatattgaaacggcttcagcagacggtttcttctattcatcagtttgacaaatccatagatcagcagaatgacgaataataacgccccgatcatctttacaaaatcaaaagcggagacagaagatgcagaagcatcccctatctcttgatcagccgtttgtttcgatgtatcgctttttttctctgttttgtttgttgattgtttgtcaaaccattcgttgacggtggaattatcagactctgccgcaaaagcagggaacggatgtacattgagtaaaacgaaataacaaatcaaagctagtaaaccatgactctttttcaacagtcgtacaccctttagcttaatgttttattaatggcttcaagcacgcggtccgcttggaacggtttcacgataaagtcttttgcgccggcctgaatcgcgtcaataaccattgactgctggcccatagccgaacacatgatgattttcgcctgcggatcgatctgtttaatttcctttagagctgtaatcccgtccatttcaggcattgtaatatccattgtcactaggtcgggggaatgctctttgaatttttcgactgcctgcgctccgtctgaagcttcagctacaacgtcaaaaccgttcttcactaaaatatccttgatcatcattctcataaatgctgcatcgtctacaattaaaattctgtgtgccataatctgtttctctcctctatgttcgcttattttaaattgttaaggcggtctgcctgacttaaaatatcagtgactctcacgccgaagttttcttctatgacaacgacctcgccctttgccacgatccgctggttgaccaggatgtccacaggttcaccagccagcttgtcaagctcaataatgcttcccgcagaaagttcaaggatttctttgacgcttctcttcgttctgccgagctcaaccgtaacggaaagcggaatatccatcagcatatcaaggttattccttgatccttgcgccgcttcgttatgatcaaacgcctggaattctaccggagcgacttgaacaggagcagctttttttgcggttccctgtctcttcggaagctcgggttttgcctgcggctccggctgcatggcaggttccggctgcggcgtttcgtatgtttcctgtggttctgatgcggtttctgcggcctctgactcatgctggtccgcagtcatcaggtctgcgatcagatctttcgcaaacgtaatcggataaagctgcatgatgctcgaatcgattaattcgccgactttcagacggaatgacacttttacgagcaggtcatcctcaggtattctgtcggtccctttttcttccgtcacatccagaagttcaacccttggcggagaaatgtcaatctttttactgaatacggtcgacattgacgtagcagccgagcccatcatttgattcattgcttcctgcacggcgctcaggtggatttcaccgagtgacggatcggcgccccggccgtctccgccgatcatcaaatccgcgatgattgccgcgtcgctttgttcgacgacgagcaaattgctgccgtcaaagccttctgtgtagttcacttcaatggcaacatacggatgaggaaattcatcactgattttgctttttgaaatgacggtcacactcggtgtcgtaatgtccactttttgatttaaaagagtggacagcgccgtagccgagctgccgaacgaaatattcccgatttctccgatcgcatcgcgctcaagttcagacaagttcgcctcttgaggctgttctgtatcctctgactgactgcttgtgccgttaagaagagcatcgatttcatcttgagataatctattgttcatcttgttcacctcttatgtcgtgatctaaaatttgcactgcctgtcttcgattcacccggccggcctgccctaaaaacttcggtttgtttccgaccaatacagtaagaggatcagtcactgatttgtccagagttatacagtccccgacttccaaacttaaaaattcttctattgtcagttcagaagcgcccaagagagccacaacgggaatttgagccgtcatgatgcgcttttcaagcagcttcgtttcttcgggcttcgcttcattccggtctgattgcatccaataatgtacggaaagcttagggataatcggctcaagtacgacatggggaatacaaagattaatgacaccgctgatttcacctatctgtgtattgagagaaatgacaacgactgtttcatttggggaaaccatctgtacaaactgaggattcacttcaaattcagtcatttcagggtcaatatcagcaatcgattgccaagcttctttgtagttgcccagtgcattttcaaataagttagaaataatattcgtttcaatttccgtaaggctgtcagctttgttatgagtgatgccgatgcctcccatgacgcggtcaagcattgcgtatgcgatggtgggattaacctccatcatgattctgccttccatcggatgaacatcgaataaatttaaaatcgtcatgttcggtatggaacggataaattcttcatacggcacctggtcaactgagctgacggatatatgaatatacgttctgagcttggcggaaaagtgtgttgtgagaagcctcgcaaagttatcatgtatccgggttaaactgcgtatctgatctttcgagaatctgagagcccgtttaaaatcatatacctttacttttttctctttaacttcctttttcagctcttccgcatccgcctcacccgtggaaatggcggaaagcagtgcgtctatttcattttgggagagaacttctcctgacattttcttcacctccgtattctgtcaaatttgtttttattgcagattaaaggaggtaatgtacactttctgaacttttccttcttggagatagctgtttactttctcttttaatgattgtttaaacgcttctcttcctttatctccctcaatctctccggcgcttgtgtcagctaaaatggaaatgatgttgtctttcacctgaaaatcgcgtttttcaagttcttccttcgctttagccgagtcggtttcaagcttgatgccgatacggatgatgctgtcagactttaagtttgtcgtgatatcgtcgacagacacagtggctgcaacgacttcgtcaattgtcggctttttatctttgccggaatgtccgctgacgacaaaatatgctgccgttccgaggccggcgatgacaattaaaataatcagcaaaatgatgactaattttttcttcattcttcttcctctattccctgatccagtgaaaatatttgtatgctatggtaaaacgatatgacttttttgagaactgcttcttccggttctttcacaacgaactttttgccgttggacagtgtaatcgtcgtgtcggggaagcactcaatctgttcgataaacagcgcgttcagcgtaaaaggctggccgtttaaacgggtgacttgaatcatgcaatccggagaagcggcctaaccgcctctcctccctccttaccgtttcagattaaccagctcctgaaggatttcatctgaagtcgtaatgatttttgagtttgattggaaaccgcgctgagcaacgatcatttcggtaaattcatctgtcagatctacgtttgacatttcaagatagcctgccaaaagcttacccgttccgttttcgcccggagtggtgactgcgctcgcagctccggaacttaatgattctctgtaaaggttgcctccgattttttccagaccggcgctgttagggaacgtgaccagaccgatttgtccggcatcatgaaccgcatcccctgcatcagtgtatgtaacggttccgtctgcaccgatgctgtaatctttcgcatcagtcggaatattgattttgccgccgccgattttttcaaggtagtacccgtcagtcgtaacaaggttgccttgattgtcctttccgaaattccccgcacgtgtgtaaacgattcccgaacctgtattaatctgaaagtagccgtctccgtcaatggctaggtcggttttattctgtgtagcctgcggggcgccggttgaatgaacgacatcaatggaagaagtcgcggcacccaggccgatttgttttgaattggtcacgtttgaaccgccggcgactgtctggctgatcatatctttaaatgtaacgcggcttttcttaaatcccactgtgttgacgttggcgatgttattgccgattacatctagttttgtctgaaagtttttcatgccgctgataccggaatataatgaacgtaacatgttaaattccccctgggtttctttttatttagatgtttcgctgacggccgtgacattccacggactgacctctttgccattttcaagcacgagcacgtaattgccgtttgaatgcttgactgaattgactgggcttgtctgatccttcccgtcgctgtcgctgaatgtgacatttttgccgatccagttcacatacatcgtaaacggatcttgattttctacaaatttagtcatcgtcgtattcatattcatcatttgttccaatgaagaaaatgtcgccatctggctgatgaattctttgtcatcaaccggattgagcgggtcctggttttgaacctgtgtcattaagatcttcagaaattcgtctttccctaaattcgtactgctgtttactgcggaggtgctcttcgcgtttgaagtggttgaagcgcccgccgcggcataatccgagtttactgatgtcacctattcttcctccatttcattgagagaaagctcctccagcatatctccgaaatcgcctgactgctgcttgttcttctgctctctctgtccctgatgctgctgtttattgtgatcggccgtctgcccgtaaacaggctgctgatccccgccttgaagcgggactgtaaaacggtcgacctggaccgacatattcggaagcgactgtttcagctgaggaagatgctgttccagcagctctttcgcggactggctggatgcgattattttgctttgaaacatcccgttttcgtttgtcaccttaattgtgacaaatccgaggttctcgggattaagacgaatcgtaaagcttccggttgttttcccgaaaggcgtgtatttcatctgtttccagccgctgatgacctgatccgttaacggtttattttctgccggctgctgttcagctcctgcggacgcttgctgaatgccggcaaggcttctcgttcccgaaaacagtatatgtgcagacaatttgctgtcaggcgcctttgcgtgagaaaccgtgccgccgttttgctgttccgttttcccggctgactcttgggatgattcagatgattgagataacacaaaagctttcagctcagtttcagccatatcccattcctttgttcccttttgagaaaggcccgcaagctgctccgcgacgctttgaaagctcttcagctcagcggctgtcatggagtaaagtttagatgcagattcgtttttcggaaaaaatgtctgccgcaggtcttgaatcacgcggtccggaacaccttgttttttcaatgcctctaataaacgggcgccttcctggtaaaccgcctttgcctgcgtgctgtccggcagttcctgctgagatgtgaagagctggaatacggcttcttgaatgaaaagcaggcccttctcaagcgcatccttgacggaatccccgtcttttgcggaagaatccggctcattcgtttcaggcttcgccccatgctgttttcccgctaacatgtcttcaacggattcggcaagctgtttcaataaaggaagagctgtttcagccgtctgctttccttcaagagcttttaccgcctcaagcagctgtttaagctgcaattctttatcttccgggccggctttcagccaatcaccgattttcgatagggcatcattcagctctgcgtcacttgtttttgtttcatctccgggctgccggggagaagtgatttccgacaggagccagttctgaaatagacctaagctgtttacattcatcttcacattgctgttttgcgcagtctgcgtacgattacccgttaattcaagcagcttcaacttacatcactccttatttccgtcagcggatagtttttctgtatatttagccgcttgttcaggagtcattttcgtcaagatttcagcaagctgctttttacttaatccgtttaaaatatcgagggcttctttttctttcagctttacgataatgcttgccgctttaccgctgtccatacttttatagatgttgatcattttatcttttccggctgaatccgaagcgtcttttttcgtttcatccgtcttcgttttctgctgctgttcagcttcctgtttcagcgaacggattttctgattcagattatcgatttcggacttgcttgtatctaaatctttattcaaaatgttaatttcacttttttgttcctttatggtcttttcaagagaagccgttctgtcttccttctgcttttccgccgcgcttttcatttctttcgtttcgggaaccaattcttttaaaacaggcgttttagcggctgtttcctgaatcggcttcatcacatcaacgccggcagcccaaaggatgatgcttgcgacgatgatcagaaaaatcagcgggatcatgataaaaagcaggattgaaccgaactttccagatctcttttctttttcggccatttcattcgctcctaatgcccctgaatcataaactgcttgattgaaatgtcatccatttccctcatctctgcagctttgtcttcaagtgcgaacatattaaattgtttttcccgcattttttcaaatttctttacttcaatgtttttttcggtgagctgttcctgcttctcattcatttcatttcgtttcatgatgacaagcttttgataatgatagatggtgttctcaagattggaaacgaattgctgataatgtctcatttcctgaacgctcatcccgcatttcagctttgattctttgtctttttcgagcaattcttttttgctcatattttcatatagtttttcagccactgtctcaaattcagaaaccgattgtctgtattcagtcaatgtttggtctttttcattttcttttaattccagcagcttttgaaatctgaattggtacgccatgatgtttattcctcttttcctgtcagactcgtcaatgccgcaatgctgtcttccaattgagcaggttcttccgttccttgttttaaaaattgaataagctgcggataaaactgaatcgcttcatcaatttctcttgatgaccctcttttgtaagctccgatattaatgagatcttcagagttttgataagttgacagaagatcgcggaatttgttggccgcctctatgtgcgctgtgtctgaaatattagacatgaccctgctgatgcttttcaggatgttcacggccgggaactgtcctttgttggcaagcgcccgatcgagaacgatatgcccgtctaatattccgcgcaccgtatcggcaatcggttcgttcatgtcatctccgtcaacgagaaccgtataaaaagcggttatcgttccttgttcatttgcgcccgttctttccagcaaacggggcaaaatagcgaacacagaaggtgtatatccctttgttgtcggcggttctcccgctgccaggccgatttcccgctgagccatcgcgaccctcgtgacggagtccatcatgaacatcacattccggcctttatcgcggaaatactccgcaatggcggtggccgtatacgccgctttcaatcgcattaacgcaggctgatcagaggtcgcgactacgactatcgagcgtttcaggccttcttcgcctaaatccttctcgatgaattcacgcacctcgcgcccccgttcaccgacaagtgcgataatgtttaaatcagcttcagtctgcttcgcaatcattcccatcaaggtgctttttccgactccgcttccggcaaaaatcccgattctctgcccttttcctaccgtcagcagactgtcaatcgatctgacgccgacacccatcttttcccgtatcggcgggcgtttcatcgggtttggcggcggctgttccgtcgaaacgggggacaaacctttcggaagcgcccggccgtcaagaggttcgccgaacgcgtcgacaacttgtccgattaaacccgcccctactttgatgcggagcgactcgccagtggcctccacaatgctgcccggcgctatgctggccgcttccagataaggcattagcagaatgttttcatcctggaagcctacaacctcagctttaatcgcttttttcgcatggcctttcggataaatgagacaaacatctccgattgagctttcgggcccttttgattcaatcatcagcccgatgacccgtttaaccttgccgtagcgtttgtacggatccgctgtttcaattgagtctattaaatactgtgtcttcattgctccgctcccgcctcaagcgccgttaaaagcttttgctttaattgcatcagctgagtgtctatgcctgcatcaacacgtccgaacggagtttctatcgagcacgttcccttcgcggctttttcatcggcatataagcttaatctgcattctttgtataacagctgctgaatttcgtccatatgctgatgaaccgtctcataatattcagggtccacatagatggagatgtcatcataatcttttacttcggctactacctgtttgaccagcagaaggaaagcctctttatcgtcacttttttgccgccatacttttttagcgagcgcaacagaaagctcaataatttcttcctcagcgctttccagtttttcctcgactgattgtctggccatttccataacggcattggcccggctgatgagattggcatattctgcttgagcatcggcttttcccaatgccatgccttctttatatccttctgccttcgcttcttcaatcaatctttgtttttcttccgcccagcggtttttctcttcttcaatctgccgaagagtgtgatccaattgacttttcgcttcttcagacaccctgtcggcttcggccttggcaaaggccatgagtgcctccggattttcaggttcctcccggtctggctgggaatgtgttttcctgacttcctgcaaggatagcttgcgccgtttttgttcaggagaaaatgatgtttgctgtttaatgatattagacaataatatcgtctcctccgcctcgcgcgattacaatttctccggcttcttccagcttgcggacgacgcccacgattcttgattgcgcctcttccacatcacgcaaacgcacaggccccataatttccatttcctctttaaatgtttcaaccatacgctgtgacatattgctgaagacaatctctttgacttcctcgctcgcaaccttcaatgaaagcaggaggtcgtcgttttcaacatctctgatcacgcgctgaatcgcacggttatcaagggtgacaatatcttcaaagacaaacatccgttttttgatttcatccgccaattcaggatcttggatttctaatgaatcaaggatcgttttttccgttcctctgtctacgccgtttaacacttcaacaacggcttctatgccgccggtctgcgtataatcctgcgtaaaggaggaggacagcttttgttcaaggacccgctccacttcatttatgatttcaggagacgttctgtccataaccgcaatccttcttgccacctcagcctgaacgtccgggttcagctcagacaaaatctgtccggcctgcaccgggtcaaggtaggataaaatcagcgccatcgtttgcggatgttcctgctgaatgaaatttaaaatctgttcgggctccgcttttctcgcaaaatcaaacggctttacctgcaaagaagaggtgagcctgtttaaaatgcttaccgctttgtcttctccgagcgctttttcaagcacttggcgggcgtaatttaaaccgccttgtgaaatatagtcctgagcgattgcgatattatgaaattcttcaatgatttcatcttttctttgatgatcgacgcttctgactcccgaaatctcgagagtcaacctttcaatttcttcttcagacaaatgcttgtacacagaagctgatacatcaaggcctaaggaaatcatgaggatggctgctttttgttttcctgtaagcttgttctgatcacgtttcgccattttccattccccctaatcctcgtccagccagcttcgaagcaatttagcaaagtcttccggtttttctttagccattttttcaagctgttttcgtctgactgtttcttccgtttcaattttctcttcgttgatatcaggcaatcgaaccggctccggcggtgtttcatattcatattcttcgtattcatcctcttgtgagcgtttctttctgatgaggagaatgataagcagaataatggccgcaagcagtacgccgcctgtaatatatacccagatcggaagacctgaagattgtgccgaatctgtgttcaggcttgtttttccgtcaaacggctgaacggatacaacgattttattgttgatatcattgtctgtcaggttttgattttgcgtttcgtttttatcaagagacgttctgacgaccgttcctaaaatcttctgtatatcagcctgtctctgtgccgataaggaagcggcatttttcggattaggcggctccaccatgacctgaatgcctaaatcacgcactttatacgggctttccgcgatttctttatgaatgcggttgacttcatagttgattttattgctgcttttttcgtagtccccgctgtttgaaccgccgtttgtctcggcatagttcgcggtgtcattgcttcccgttccggccgtgccgccgttggccgcgccatcgcctttatacgtttccgcgactttttcggcgcttaccgctatgccttccatgttatctttatcgacaggttcgacagtgtcttcagtgcgtttttccttcgtgaagtcaatatccgccgttacagaaacaacgaccttatcctgccccatcattgtgccgagcagtgactgaacatgtttttgaatgtccttttcgacctgcgacttaataccttgctgagatgcataactgtcagaaacggaccctgcaccgctgtcacttttgtcataatatgtagaattttgatccattatgacgatattatcttcttttaagttcggaacacttttagaaacgagatggtacagcccgttgatctggttttgatcaagcgagtagcccggtttcatctgcaaaacgatggatgcggacgctgccggctgatcttcaccgacgaacacggcttctttcggcatattgatcatgaccttcgagcttttaataccgtccatttcatttatcaggtttgacaattcggtctgagtcgcctcaacctttaaaacgtcaaactcattatctgtcaggccgaagcccgcattttgtccgaaaaacgaataatcaattgatcccgttttcggcaggccttccgcggcaagctggactttaagcgaatccacttggctctcaggaacctttatgaccgtgccgccgtcagcaagttcagaagacacctttttcgtatcgagctcttctttaatcttccccgcttcttccgcggacaaatctttataaagaggcaccatcttttcagacgaagtaaaaataataacgacgatgagtaaaataatgaatgcggccaagccgcttaccatgagtatcttctgtgtttttgatctgttgttccaaaacgctgccgttttggttttcatttgcattagagtacgattcatgttaacccccggtcattccagtcattctcttcaatctgaccactacatctgcattctcatgatttcctgataggcttccacggctttattgcggaattcggtagcggccgtcagagaaatatttgctttttgggcagcgatcatgacctcgtcaaggtttacatcctttcctgcagccagttcgttcgttatttggtcagattttacttgtgactcatttaacgaatcaatagagttttttaaaagctccgaaaagcttgtttggtttgaagaatcagttttttgagtttggtttaattgattcgttacgttttgagtgttttgggtttgttgaagctgaaaaggagtaatagcgttaaccacttacatcaccttactttccgatttctaaagcctttaaaagcatgcctttggaggcgtttaatgcagttacgtttgcttcatatgatctcgtgctgctgacaagatccaccatttcttttaatgggtctacatttggtttttgtacatatccgtctttattcgcatcaggattctccggatcataaacgagattaaaagcggacgggtcttccgtaacgccagatacctttacgccatttcccgcgcttcctgttccgttcatcttggaatgtaaaagggacgaaaatgattcgcctccggattggagagataccagctttcttctgtaaggcacccattcgccatttacctgcttcgctctcgttgtgtccatattggccaggttggacgatacgacgtccatccggacacgctgtgcagttaaagcggaacccgaaatatttaagctttgaaagccactcattattttcctcctgtcaagacggttttcagagaattgaatttgccgctcattctttcaaccaaagcctgataattaatttggttttcggctaaatctgtcatttctttgtcgatatcgacattgtttccgttttgctggtacgatgtatcactgctggacacgatagaataatcgtcccttgaacccgtaaagtcaacgtgccgatagtcggtttttaccgcctcaagattggatgtttcctgatctaacaaatttcggaaagagactttttttgccttatagttcggtgtatctatattggcgatgttattagttaagactttttgcttaatgtccgctctccccaaggcattctcaagattttgtatagttccagaaaataagtccaaatccacttacctccatttcagatatttttctcctaaaaatccttgtcgagaattgtaaaaccatatgcttattgtaagaaataacaggcttaaagtctatgaagttaggctaaaaaaaagtgctcaattatatctattttgcatgtaggtattaagtcctagagtatttggactacaagtatttgtttaatataagactgaaaatagcagaatttctgtatcttcctccttttttcacacagcaagatggattatctcagatcagcttccaataagcaactttaaactgcaacttttcacctattgtccataaaaaaagcaggacccccattttcagggatcctgcttttgtcttaatgagatttaaggttttccaattcaataaggaatttgttgttcagaactttaatgtacgtccccttcatacccagagatctggattcaatgacgcctgcgctttccagctttctcagcgcgttaacgattactgaacgcgtaatgccgacacggtctgcaatcttacttgccacgagcaagccttcgtttccgtcaagctcttcaaagatatgctcaatcgcttcaagttcactgtaagacagagaactgatcgccatttgaacaaccgctttgcttcgcgcctcttcttcgatttcttccgctttttctcttaaaatctccattcctacaacggttgctccgtattcagcaagaatgagatcatcatcttcaaattgatcctgcagacgggacagaatcagcgtgcccagtctctctcctccgccgatgatcggcacgatcgttgttaagcccgcttggaacaggtctctgttttccacaggaaatgccgtgtattcgctgttgatatcaaggtttgaagacgtctccggaacattgaacagatttctcgtgtactcttccgggaactggcggtcttcaagcatttttttcatgcggtcattttcaatctgctgattaatagagtagcccaaaagctttcctctgcggctgacgacgaaaatattagaatcaatgacgtcacgaagcgtttcagccatttctttaaagtttacgggtttgcctgccgcagcctgcagcatgctgttaataattcgtgttttttgtagtaaagccatgataaataatcctcctagaattcctcttattaaattttcacaatataaattgacttagatctttgttgtttgcaatcgttccgagcttttcttcaacatattgcggcgtgatggcgactttttccatcgtcacgtccggcgcttcaaacgacaggtcttccaagagacgttccaatatcgtgtgaagccttctcgctccgatgttgtccgtatcctgattcacatgataagccacttcggcgatcttacgaatagcttcgtcagaaaattcaagagatataccttctgtctgcaataaagcctgatattgttttaacagcgcgttatcgggttcgacgagaatcttcacaaaatcatccaccgtcagcttgctcaattctacacgaatcggaaagcggccctgcagctccggaatcagatcagacggtttggccatatggaatgccccggctgcgataaacagcacgtgatctgttttgacggagccgtatttcgtgacgacggtagatccttcgacaatcggaaggatatctctttgaacgccttctctcgatacatctgctgaggaagaagcccctccgttttttgcaattttatctatttcgtcaataaagataatgccgccctcttcagctcttaacacggcctcttggccgacttcatccatatcgattaatttgcctgcctcttcattggtcagaaccttccttgcttctctgaccgtcattttgcggcgttttttcttttttggcatcagattgctcagcgcatcctgcatattcatgcccatctgctccatcccggagccttgcagcatgtcaaacatcgacggctgctgctcttccacctctacggagacgtaatggtcttcgagctctcccaatgcgagctgatgcgccatgcgttttcttttttcttcaaggcttgcttcttcctgctgatcggcttcatcatcatttgccgtctgacttcctccgaaaagcatttcaaacggatttttcacacccgcttgttttttctttcccggaacgagaagccgcacgatacgtttgtttgcattttcttcagcctgttctttcacttcgctgattttttcttctttaatgagccgcacggatgtctcaacgaggtctctgaccattgattcgacatctctgcctacatagccgacttctgtaaattttgtcgcttcaatttttataaatggcgcaccggtaagcttggcgatccgtctggcgatctctgttttccccaccccggtcgggcccatcatcaggatgtttttgggaacgatctcgtctctcagtttttcatcaagaagacttctgcgatagcggtttcttaatgccacggcgacagcttttttcgcatcctgctgtcctacaatgtattgatccaaccgatctacgatttgtctcggtgttaacggtttgttttccatgcgcctcaagtcctttctattcaagttcttccaaaatgatctgatcgtttgtgtacacacaaatctcgcctgcgattttcaaagcggcttttgcaatatctttggcggacagattctctccggcataggttttcagcgctcttcctgctgacagggcgtagtttccgccggagccgattgccaaaattccgtcatccggctcaatcacttcacctgttcccgatacgagaagcaaggtatcctggttcatgacaatcagcatggcttccagcttgcgcagcactttatcgctgcgccattctttcgcaagctcaaccgacgcacgttttaaattgccgttgtattcttcaagcttcgcctcaaacatttcaaaaagtgtgaaagcgtctgcaacagatcccgcaaatccggccagaacctttccgttaaacagctttctcacttttctcgcggtatgtttcatgactacagcctgaccgaatgtgacctggccgtctcctgacatagcgcttttcccgttatgctggacggcaaaaatcgttgtcgcatgaaaagatgacatgagaagggcctccttttaattttctttaaaagctctcgggtggtgggacatatatgtgtttctcagcatttccttcgatacatgcgtgtatatctgcgtagaagacagattggaatggcccaaaagctcctggacgcttcttaaatcagccccttcattcagcagatgagtcgcaaacgtgtgccgaagcatatgcgggtgtatatgtaaagtgccggatgctttttttacaagcccgcttaaaatataccggattcctctggcggtcagcgggccgcctctttgattgacaaacagcacatcatgaggctcttttgctttttcaagcaggcactgccttccgctgttgatatacagctccagcgcatcacgggcatatgagccgaacgggatatagcgctgcttcttgcctttcccgtgaacgagcaccgtatccatgaacaggtcaagatcgccgacagtgagcgtacagcactcactgaccctcattccggtcgcataaagaagctcaagcagggcctgatcgcgcatccctgacggctgacttctgtctgagacagcgaatagttcctcaagttctttttcataaagaaacttcggaatccgtttctcttgtttcggcagatgaacaagctgaaacggattctcttcaacaagcttttccctcattaaaaatttatagaagcttctcaaagctgaaattttcttgctgattgttcttcttgacaggcctttttcataagcctctgtcaaaaatattctcacatcatgatatgcagcttctttcattccatttatattttgagcatgcagaaacatcccaaattcttcaatcgaattaacataattcacaatagtatattgtgaataatttttttcaatttgtaaatattcaacgaataactttaaaaaaaagttaacattctcagtcattatgaagacctccctctccgaagggcttttaaatggtatcatataatgcatcgaagttgcaatgaaaagctatatcgttttcgaaatagtttgaatagtctcaattgcgcgtttagcgtattcttcatttcgttcttttttgtttttaatttttacaggcaattcttttaagaggccgaagtttgcattcatcggctggaagttcttctgatttgtcgtcgtaatgtagtgagccatgcttccgatcgccgtctcctgcgggaatgtcacaagatcctgaccgagcacaagtttggcggcattgattcccgctacaagacctgaagcggcagattcaacataaccctctacaccggtcatttggcccgcgaaaaacagatcgttccgctgtttaaattgatatgtcgggttcaaaaggctcggcgagttgataaatgtgtttctgtgcatgacgccgtatctgacgatatcaacattttcaaggccggggatcagtttcagcacttctttttgatctccccattttaaatgtgtctgaaaacctacaatattataaagcgttcccgccgcgtcatcctgtctgagctgaacgactgcataagggcgcttgcctgttttcggatcttccagtccgaccggtttcatcggtccgaacagcatcgttttcttgcctcttttcgccatgacttcaatcggcatgcagccttcaaagaagatttctttctcgaattcttttaaaggaaccgtctcagccgtcgtcaatgcttcatagaaacggtcaaactcttcctctgtcatcgggcagtttaagtatgccgcttctcccttgtcataacgggattttaagtacactttatccatatcaaggctgtctttttcgacaatcggcgccgccgcgtcataaaaatacagatactcttctcccgtgagctctttcagctgctgtgaaagcgattctgatgtaagcggtccggtcgcgataaccgtcgggccttccggaatctctgttacttcctcagtaagaaccgttacgttcggatggtttttcacgagatccgtcacgctttgcgcaaattcatggcggtcaacggcaagcgctccccctgccggaaccgagcatttatcagcagattgaatgattgctgagtcaagcgcccgcatttcttcttttaatacgcctaccgcattggcgagtgtatttgaacggagggagttgctgcataccagttcagcgaatttatcagtatgatgggctgccgtctgcctgacgggccgcatttcgtatagttttacttgaattcctcgttttgcaagctgccatgccgcttcacttccggcaaggcctgctccgattacattaactgtttgctggttcatttcttttcatctcctgttgtttgtcccttccacacaaagaaggtgagcaaggctctgctcaccgctacttctgtggttcttccttataatcgcattcgacgcattggacttgtatgccttttttaagctttttctctacgagcatattttcacatttcgggcattttcgttcaatcggtttgtcccaagatacgaagtcgcattcaggataacggtcacagccgtaaaagacgcgtttcttttttgattttcgttcgacaatatttccttcatggcacttaggacattttacgccgatttgtttaacaatcggttttgtattccggcagtcagggaagttggaacacgccataaatttaccgtatcggcccattttataaaccatccgggagccgcataattcacaatcttcatctgcgtattcaggttcaatttccacttctttcatttcagcttccgcttttttcacgcgtttttcgaaatcggtatagaagctgtcaatgatttgaacccattctgtctcgccatcttcaacatggtcaaggtccctttccattttagccgtgaattcaacgttgatgatttccgggaaaaactccatgataagatccagcacgatctgcccaagctcagtcggcacaaaccgtttattgtctaatcccacgtaaccgcggcgctggatggtgtcaagagtcggcgcatatgtcgaaggacggccgatccccagttcttcaagcgttttaaccaggcgcgcctctgtgtaacgcggaggcggctgagtaaagtgctgctcaggctcaatatcttttgataaaaccgtgtctccctctttaaggtccggaagcatgcggtctttttcttccagctgatcgtctttaccctctacatagactttcatgaagccggcgaatttgactttacttccgtttgcccggaatgtcaatccgttattgctgagatcgacgctcatcgtatcaagtacggcaggcgccatctggcttgcaacaaaacgctcccaaatcagcttgtatagtctgagctggtctcttccaagcaccgcttttaagtcggcaggttttctgagcaccgaagtcgggcggatcgcttcgtgggcatcttgagcgttttcatttttctttgccggtttccgttttcccgctaagtactcttttccgtatgcctgatcaataaaagctgacgcctcttcaacggctgtattggaaatccgcgttgagtccgttctcatatacgtgatgagtccgactgtcccttctttgccgagatcaattccttcatataattgctgagcgatcatcatcgttttcttcgctctgaaattcagcttcctggcagcctcctgctgcagagttgacgttgtaaacggcagagcgggatttcgtttgcgctcttttttcgtcaccttgtcaactgtatacttattgcctttcagctgagcaaggacggcttttacgtcttcttcgctttttaaaggaagctttttgccgtttttcccgaaaaatccggcttcaaacgtctcttttccctttaaaaatgagccggtaatcgtccagtactcttcaggtttaaagtcattgatttccttttcccggtcgatgatcagccggagcgcaacggattgaacacggcccgcactgaggcctttttttacttttttccaaagaatcgggctgattttgtatccgacgagtctgtctagtatgcggcgcgcctgctgcgcatcgacaagatccatgttaatcatgcgcggatgtttaaatgattctttaatggcgtctttcgttatttcattaaagacgacccggcagtccgagctgagatccagatcaaggctgtgtgcgagatgccatgcaatcgcttctccttctctgtcggggtcggccgcgagatagactttttttgctttctttgccgctgtttttaattcttttaaaacagggccttttccgcggatcgtaatatatttcggttcaaagttctgttcgatgtcaactcccatttgacttttcggaagatcccggacatgtcccattgaagctttgactttatatttcttccctaaataacgttcaatcgttttcgcctttgccggcgattccacgatgactagataatcagacattttcatccccctcaagaggtgttctctctcttttcaagtatcaattcattttagagctgcctttttatggctttcaacatttcattctttatgatgaacgtcattttatacatgaaaataatatgcaactttaaatcctcactattattaaatattacaataccgtttgtcaaacgatatttcaaaagggttccgtatactgaacgcatcgggcggtcagctctccgtcaatatcctctgcgcataatacagctttcgccccttcttgaatgagttttataggtcctccggaatatggattaaatatggaacccggaacggcaaatacctctctgccttgatcgagggcctggtaagctgtgattaatgaaccgcttttttcttttccctgcacgaccacaattccttcacttagtccgctgattatgcggtttctcatcggaaagtgccattttttcggctttgtttcaggaggatgttctgagagtaggagatggtgttcagccatgtattctgctaacaggagattttcccggggatagatgtgatggaatccgccggctatcacgccgatcgtaagcccttttgccctgatgctcgccttatgagacaaaccgtctataccggatgcaagcccgcttacaatgacccagcctttttttgagagttcggcggaaagatgcccagccgcttttattccgtcttccgtcggtttccgcgttcctacaatcccgatttttctgcctttttcaagaagcggtgtgttcccttttgcatacaagacagccggcggatcataaatcgctttaagccatgttgggtagcagcttgatgaaatcggaataacagtaatgccttcgcggcggtaatcggacagaacttcatcaagttccggatccttgcgctctatttcccgaaaaattgcttccggggctgttttcccctctgataaaacagttaatggatgcggatccgaaaaaaaagacagagagtgatcagctttccaccattttaatagaagagacggggaaatgatttgattaatactgcagaccattaaacagcgcgatgcttgatccaaatctggcaacctcctcttttttcagcaaaaacaggaacagccgttacggctgcccctgcttcgatcagtgcgttttgcacgtttcaaataagcctttttcttttaacaccttaatcagcgtttcacccattacagaaggggtttccgcgacttcaattccgcaggcgttcatcgttttgactttttcttctgccgtgccttttcctccggagatgatggcgcccgcatggcccatgcgttttcccggaggcgcggttttaccgccgataaagccgacaacaggcttcgtcatgttcgctttcacccactcagccgcttcttcttcagctgtgccgccgatttctccgatcatgatgacggcatgtgtttcaggatcttcattgaacgcttttaacacgtcaataaagttcgtgccgttgaccggatcgccgccgattcctacagcggtagactggcctacgccggcttctgaaagctgatggacggcctcgtatgtcaatgttcctgaacgggatacaacgcctacatgaccctttttatgaatgtatcccggcataatgccgatcttgcattcttcaggtgtaataacacccgggcagttcggccctattaatctcgttttcttgccttccataaagcgcttcactttcaccatgtccaaaaccggaatgtgctcagtgatacaaatgacaagatcaatttccgcgtcaaccgcttccataattgcgtccgccgcaaacggagccggcacgtaaatgactgacgcatcagcgcccgttgtatgaaccgcttctgcgaccgtattgaataccggtacgccttccgcttccgttccgccttttccaggtgttacaccgccaacgatattcgtgccgtattccagcatctgctttgtatgaaataaagcggtagaacctgtaatcccctgtacaataactcttgtatctttattgataaaaacactcattatctggtcccctgcctttcattctttcctaaactaaggatacgattttctgtgcgccgtctgccattgattccgcagatgtgatgtttaagcctgattcattcaggattttctttcctaaatctacgtttgtcccttcaaggcgcacgaccagcggcaatgtcaatccgacttgtctcgtcgcttcaacaacgccctcggcgatgacatcacacttcatgatgcctccgaaaatattaacgaaaattccttttacgttttgatcggaaagaatgattttaaaagcttccgtcactttttctgcggttgcgccgcccccgacatcaaggaagtttgcaggttctccgccgtagtgtttaatgatatccattgtagacattgcaagacccgcgccgtttaccatacagccgatatttccatcaagggaaatgtagcttaaatcgtattttgacgcttcgatttctttcggatcttcttcatctaaatctctgtattccataatgtctttttgtctgtataacgcattgctgtcgaagttcagcttagcatccagcgccatgacgtttccgtcccccgtaacgacgagagggttgatctcggcgatggagcagtccttctcaacaaatgctttatataaaccgagcataaatttagcggctttgccgacaagctctttcgggatgttaattgcgaatgcaatttcccttgcctgatagccctgaaggccgacagccggatcaattaccgcttttttaattttttcaggtgttttttccgctacttcttcaatctccgttccgccttcttcagacgccattaaaacgattcttgaagtagcgcggtcaagtacaagcccgacatagtattcctttttaatatcgcagccttcttcaataagtaagcgttttattacttgtccgtccggacccgtttgatgtgtgacgagcgtcttgcctaacagttcttcggcatactctttcacttcatcttttgtttttgcaatctttaccccaccagctttgccgcggccgccagcatggatttgcgcctttacgacataaaccgagcttgacaggctctctgctttttcaactgcttcctctgctgtaaaagccactttaccttcaggaacagacaccccgtattttctgaggacttcttttccctggtactcatggatattcatttcccatcctcctaacttatgtagcaaaactaaaaatagactgcgctttcattctatataatactggaagaattgtctagggttcaaaacaaaatctttatatccttccaaacattctaacttttattttattgaaaatataaatttaaacggagtccgggaaatgaatggtccttatttttcgtttttcagggttttgtccagtctgtaaacaaatgaaaaaatttcggcaacggtttcatagagcgcctccggtatgtgatcgtcaaccgtcaaatggcgcattaattcgacaagggttctgtcttcctgaatggggaccccagccttctcagcttcttttataatattttccgccacgtgccccctgcctgttgcgacaaccttcggggcttggtctttctgccggtcgtaatgcagggcgacagctcttcttaacggcgtttgctctttcatattttcacatccacttttcttccgccgtctttttctataaactcttccacaagagcgctctggtctttcgggcgccgttttttagacgtgacgcctgacaggctgaagcccgtttcttttacggcttcttttaaagccggtacgagagggtcgatggccgcctgaagctcaaaatcagtctcaaccgtaatggtcattacattttgctgaatcacgcagtccacaacggtttcttgcagtgtttcaagatgcagcaaaaacaggagcctgcaatgtgacggatcgagttttccgtccggcttcttccgtcctttaaagagaactgtgatgtcattctcatacgcggacgctcccagcggaaatgacagcaccatctgcgtaaaagaagggttatgctgctcaataaacagctggccgtttaatttatgaataagcggttccgcctcttgtttaacggattggggcgcttcttgaagcgtccggacggcttggagggccgttttcagcgcttgtttctccggctgcggagatacgcctttttcaagcgctgtaatgaatgataattcatcacgcgtgcccaatccttttttgattttctgcaaaaggcttaatacatcatgtttttccgcatatttcaattcggtgagctgaacggctttttcgaaaacagccgcctcctgttctgtcagatgtgctttttgaagaacaggtgctgttttaaatgttttttcttgagaaatgaaagccttaatgatctccgccgttacttttacggggcggttttcagttttttctgccgatgtcattaatttctctataatctgttttgccgttttttcaggaagtttttgatctgtccgcgcactcggaggagaaggttggcttgagactgcctttccgttttcacgagtctctcggacaaatggtgattgttttgattccgtccgttcttcttcatccatcagcccggtttctgggatcggcatgcgtgcagcctcggcaagcttcttcaagagacgttctgcatgaagatccgtttccgcgtttaatacgtcagaaaccgcctctttgagcacagacagctcttttgccgattgcggtgcctgattgattgcctgaagcagtcctgagaggaggcgccgggtcggaaccggatatttaacggcatgaatggctgacaagacttccggatgtgcgggcagttcccgtttcagcgcaaatacgattgtttccgccgcttttttcaattcggcggccggaagcgattcagcccagcggacgcaggctttgaggctgttttccgtcatcggcagcttctgctgcataaacgtttcggcaatctgcagagacacagggcccggtttgacggaaagagcgtttaacagtctacccgccgcttcctgaacggttttcgggcttccttcgaattggtcgatgacatgaagccggcccgttttttccgccggctgtttgtcataagaaaaccagtaatacgcctgcggacgaagggcggtttcaagttttccctgcatcgtccggccgccgatctggataagagcgctttgatcgtccagcaaacggagaaccttccctaacagcagcctttgagtaccgctgtctttaccgccgtcctgccggtccggagggatttccgccgtcagctgtctgaaagccgcttggatttcgccgctaatgttcatgtcttaagcctcttttctaacaataagattgaacgggagcgaacgtttttcggtgaatagttgtcggtccgtatgcctgaagagcttcaagatgttctttcgttccgtagcctttatttttttcaaagccgtacatggggtaagttttggcgtactcagccatgagacggtcccgcgttacttttgctatgcaggctccggcggcaattgacacgcttttggcatccccttttataactgatgactgcggaatgtcaagcggaagggtcatggcatcaacaagcagataatcaggtgtttccgttaaagcattgacggcttttaccatcgccagtctcgcggcctcataaatgttgatccggtcaatgacgtccgcatggacaatgccgactcctacagccgccgcttcttccgtgatccggctgtaatactcctcgagcttcttttccgacaatttcttcgagtccgtgagaccgagaatctcgcattctgccggcaaaatgacggcgccggcgacaaccggtccggcaagcggccctcttccggcttcgtcaacacccgcaatcaggcggaagccctttttggatgacagtctttcgtatgccgtcatgtccagccattgctctttaagagctttttccttcgcatgctttttcagccattgctctaaaagcgtctgtacgctttttctcgggtctttctcacattgggcaaggaaggggtcgctttcgtccctgatctcttgcaggcgttcttttacgctttttacggttaatgtattcacgttctcttctcccttacattatgtatatcggtattctgcggaaaaaataaagacccgcatcgctgcgcgtctttattctgatggtgcttcaaatgaaagcctgccgaatttttccgtccggatgtcccgaatgataacttccgttgttttatcatagtcaaccattccgccgcccatcaaacagccgcgtttttcaccgatcgcgtcgaaaagagcggcgatatcctcagggatttcctgaagtccgtagcgctccttcaaacggtcgggataatgctcttccagaaagcgcagcccgaaaacagccacatcctgcaggttgataatcgtatctttaatcgccccggtgatcgccaggcgcaagccgacaagctcatcttcaaatttaggccataaaattcccggtgtatcgagcagctctaattccttgcctacctttacccactgctgtgaagtggtaatgccgggcctgtctcccgtcttggcaatgttttttttggccagccggttaatgagcgtagacttgccgacattcggaatgccgatgattaatgcgcggattgctctcggcctaacaccttttgctttcattttatcgaacttatccttcagcagctctttcgaggacggcacgatttgatgcagtccctgcccgttaacggagtttattgaaagagagggaatgccctgttcctgaaagtggtccttccactgggcagtcacagccgcatccgccttatcggctttatttaaaagcataatgcgcggcttattttttaaaatctcctcaatcatcggatttctcgatgacatcgggattctcgcatccaccaattcgtatacgatatcaattaatttcagtttttctgttacttcccgtctcgctttagccatatggcccgggaaccattgaatggtcatgtgacttcgacacctgccttatttaccggaaccggatgttccgatgatctcttatgtattttacgttgcttgttccgcttttacaaatttcatataaaaaaagagcctgttacgggtaacaagctcttttcgttcgttatcattatcgtctgatttctttaatacgagccgcttttccgcgaagttcacgcaggtagtaaagcttagcgcgacgtactttaccgtaacgtacaacttcgattttcgcgatttttggtgtgtgtacagggaatgtacgttcaacgccaacaccgtaagaaatcttacgaactgtgaacgtttcgctgattccaccaccacgacgcttgatcacaacaccttcgaagatctggatacgctcacggttaccctcaacaacttttacgtgtacacgtaaagtgtcaccaggacggaacgcaggaagatcagtgcgaagctgttcttttgtgatatcttgaattagtttttgcatcgttttcaactccttccaacagatgctcttggccacaactgcaaggcacagcggaacatcgttttcaagcttctgaaggataagcctccttaagccacaagtagtatcttatcatatcttcatcacctgcgcaatagaatctattcgttttcccactcggaaatccattttctttgctcatcagtgagaggatagttttcaagaagatccggacgtcttaaaaaggttcttctgattgattctttattgcgccattcttgtattttggcatggttgccggacaaaagggtctcaggcacttttaagcctttataatcggctggcctcgtatagtgaggatgctctaaaagccccgtgctgaaggaatcctccacgtgggatgcttcttttccgaggacgcccggcaaaagcctgacaacgctgtcggcaatcatcatggcagggagctctcccccggtcagcacaaaatccccgatggagatttcatcagtgacaagatgttcccggatccgttcatcatacccttcataatgcccgcaaataaacatgagatgttcctcttccgccagctcctcggctttcttctgcgtataacgctcaccttgcgggcagacgagaataatgcgcggcttggcgtccgtaccggctgtcagcttttcaaccgcatcaaatacgggctgcggctttaacaccatcccggctcccccgccgtacgggtaatcatcaaccgtttggtgtttattatccgaaaaagcccggaaattgatgacgtcaaaacggacagcctctttttcctgtgctttttgcagaatggatgagccgagcaccccttgaaacatttcgggaaacagtgttaaaaagtcgattttcattcgtctattaacccttccattacatgaatcttaattttcttctcatttatattaatatccttcaccacagaagctatatacggaatgagcgcatcttttttgccttttcttgcaaccacccatacgtcattagccccgggcgtcaagatttccttcactgtgccgatcagttccccgtcttctgacacaacctcgcagccgatgatttcatgaaaataaaattcatcttcttcaagctctcccaagtcttcttcaggaactttgatcaccatgtttcttaggtgttcgacttcattgagactcggcatttctttgaattgcagcaggtgaaactgcttgtgaagcctgtgggcgctgaccgttactttgattggctccgcagccccttccgcaaacaaatagagcgtattgccgggcttgtaccgttcttcggcaaagtccgttttagaaatgacccgcacttcgcctttaatgccgtgggtatttacaattttgcctacattaaaccatctgtttgtcatattatcacctcgggcggatttcaattactaccccgtcttttatgacgatggtatttgccgctgttttttcatgccagttatcaccgacgttgattgaaagcagcgcatcgatctccttttccttcacttcgcttccaagcgggagcgactctgtctggcttatttggaaatcaatcattttgattttatcttgtcttttttcaatggcttttttaaaagattccgctacatcgggattctgctgatctttttcatgttttctaagctgaaaatagagctggctgcattctcgttcaagcgtttgctttttttctgcaaaagaggccaaaagcttttccttgctttgctcggtcagaacctgcataacggttaccctgtgaataatctgcataggaccagactccccactcttccaacatatttctgttcatttgccttttttacgtgtaaaaaaaggggaggtgccggccctctccctttttcagtcaaatatttcaaattgaactttcttagaagactgtgcgccagctgcaaaaacgacggttcgaatcgctcttgcagtccggccttgctttccgataatcttaccggtatccgacttattgacagataagcgtagcgcaatcttttgatcagtctcttcctttgtgaccgttatgtcttccggatggtcgacaagcggagccacaatgctgacaatcaaatcttccaagttctgatcagtcattacttgccttgtttagcgttgtggaatttttccataattccttggcttgagaacaagttgcggactgtatcagaaggtttagctcctgtttgaagccatttaagagcaagctcttcattgattttcacttcagccggctttgcaaccgggttgtatgtgccgactgtttcgatgaaacggccgtcacgcggtgaacgagaatctgctacaacaatacgatagaaaggagatttttttgctcccatacgttttaaacgaatttttactgccattttactagcacctccgaaaatatttcaacaagatagtatattaacaatgataaaagtgtttgtaaagtgttttttcttaacaacggttttatcatgtataaccgattacataaaaggtaatttaaagccttttttcttcccttttgacatgttggtcatctgcttcatcatttttttcatttcctcaaactgctttaaaagacggttgacttcctgaacggatgttccgcttcctttggcaatccgcttccgccggctggcgttaataatatccggctgttctttttcaagaacagtcattgatttaatgatcgcttccacatgattcagctgtttttcatcgacttggatgttttttaagcctttcattttgcctgctccgggcatcatttgcagcagttcgtcaagaggccccatgtttcggacctggccgagctgctccagaaaatcatccaatgtgaagctcatcgttctcattttctgctcaagctctttggctttgtcttcatcaacggtcgcctgagctttttcaatcagcgtcagcacgtcacccattccgagaatccgggatgccatccgttcaggatggaacgcttcaagagcatcgagcttttctcccattccggcgaatttaatcggcgtttcggtgaccgcgcggatagaaagcgccgcacctccgcgggtatccccgtcaagctttgttaaaatgacgcccgttaaaccgagctggtcattaaagcttttggcgacgtttaccgcatcctgaccggtcattgagtcgacgacaaggaaaatttcctcaggatttgcgacttcctttacgccggagagctcatccatcagttcatgatcgatgtgcagccgtccggcggtatctaaaatcacataatcatgatgctcttccttcgctttttcaatcgcctgtctggcaatttccaccgggctgacctgatcgccaagcgaaaagaccggcatatcaagctgtttccccagtgtttccagctgtttaatcgcggcggggcggtaaatatccgcagccacgagcagcggtttgcggttatgttttttgcgcagcaggttggcaagcttccccgtggttgtcgttttaccggcaccttggagcccgaccatcataataacggtcggcgggcgtttggcggcggcaattttgctttcttcgccgcccatcagctcggtaagctcttcttttacgactttaataacctgctgaccgggtgtcagactctgcatgacgtcctgcccgacagcccgttcacttacttttttcacaaaatcctttacgactttaaagttaacgtcagcctcaagaagcgcaagacggacttcacgcatcatctcttttacgtcttgttcgctgacttttccttttccgcggatttttgaaatcgtcttttgcagtcggtcggctaatccttcaaatgccattgtttgccgcctcctaatctaatttctcaagcgcttcaatcagagccgtcattttttcctcttcctgcaagccggaagcaagctctttcagctttgtaaacatttctttacgctcctgaaactttttaaaaaggagcagtttttcttcatattgttcaagcatcgcttcagtccgtttgatgttatcgtaaacggcttgccttgaaacgtcatactcttcggctatttcaccaagggagaaatcgtccagataataaagcgacatatagctcttttgttttgacgtcagcaacgactgatagaagtcaaacaaatagttcattctcgtcgttttttcgagcgacatttgagctctcccctttgttaagtcaaatccctttacaaaaacttagtttacatggtttcagagcgtgtgtcaagtttttatcttgtcaaagcaggatgctctttttacataataagtgttttcaaaaaaattcatacagaccgtcgttaaaatactcgaattcttgttttgatacacgatagcggcaatagccttcgtaaaaagcattgagacatgattcatttgtgacaaaacgactgatcgctaatgattcatcataacgcggatctcccgccgatattcccgcagcatcgataaacagatagacctctccgtctctcaccagcacattatcagtcgtgcagtcaccgtgaatcattgtctgctgaacaggaacaggcctgtacctgtccaattccttcaaaagctctgcacttccttcagcttgtccttttttgacatattccccggctcgtttgatttgcagatcgagccagtctgtttccggctgtaaaccagagaccatttcggtttcatgcagccgctgcagaaactggccgaaacttttgatcagctttttcttttcagtatcccctttggcttttcttaaagccgaagtcagggtgattccatcctcaaatgacatgatgatatggctggcatgctgttcctgtatcatcccatagtaaataggaacaggcagacgacgagtttccgtcagttgttgtaaaacgaaggcttctctcattaaccattcccgatacttctgttgaaaagaacttttcagcaaaaatgcgtcttgaccggtcactatttttcgaacggttgaagtgcctccctgttcatccagcagcgacatatggtttatcgcgccgatcttactttccaattcagctttcagccatttgtccaacaactgccccctccattccgatctatcaatgcgtataaaaaaacgagtataaaaccgtccattttatactcgttttttattcattaatcttcggctttttcaactaaatccgaaaagagaccgtatacgtaagattctgcatcaaaccgctggagatcgtcaaccttttctccgaggccgaccagtttcacagggatgtgaagctcattgcggatcgccaggacgataccgccttttgcggtgccgtcaagcttcgttaatgcgatacccgtcacattcgtcgctttggagaattctttcgcctgcgccatcgcattctggcctgtcgtcgcgtccagcgcaaggagaacctcatgcggggcctcaggcacttcgcgttcaatgacgcgtttgaccttttcaagctctttcattaagttaactttattctgaaggcggccggccgtatcacaaatcagcacatccgctcctcttgctttagccgcgtgtacggcatcataaataaccgccgcagggtcgcttccggcagcctgcttaatgacaggcacgcctgtacgctccccccacacttcaagctgttcaatcgccccggctctgaaagtgtctccggcagcgagcacaacggatttgccttcattcttcagcttatgggcaagttttccgatcgttgtcgtttttccgacgccgtttaccccgacaagcagaataacgttcaggcgcccgtcctgaatatttaattcagaaatctgttcgtcgccgctgttataaatgtcgacaagcttttcagaaatgacggactgcacttcctgaggatcctgaatgtttttcagcttcacttcttttttgagctcatcaatcagctccatgacggttgtaaaacctacgtcagcgccaatcagcacttcctcaagctcctcgaagaaatcctcgtcgactttccggtagcgggagacgagttcgttcactttatttgagaaggaatttcttgttttttcaagaccatctttaaatttttcagagacggagtctgtctgtttcgtgattttctcttttaattttttaaaaaagctcatctttcaacctctttcctcgttactgaataaattcttttgtttcttccagtttgaccgaaaccattcgggaaacgccggattcctgcatcgtaacaccgtagaggacatccgcttcttccatggtgccttttctgtgggtgatgacgataaactggctgtcgccgctgtatttttttaaatattgcgcaaacctgaatacattggcttcatcaagcgcagcttccacttcatcaaggacgcagaacggcacgggccttactttcagaatagagaataaaagggcaatggcagtcagcgcccgttctccccctgacaaaagatttaagttttgcagttttttgcccggaggctgcgcgataatgtccaccccggaattaagaagatcattcggatcagtcagcttcagttcagcccgtcctcctccgaataaagaacggaacacgtcgttgaattgagaacggatctggataaacgtttcatggaatcgcttcgtcatttcagaatccatttcttcaatgacttgaaacagtgtgtttttcgcttccgtcaggtcatttttctgctctgttaaaaactgataccgttcgtttactctttcaaactcatcgatgctgccgagattgaccgttccgagctcttcaattgaaagcttgatcagtttgacccgttttctcgcctcttcaggctcgagttcaagctgatattgttcttttgccccttcaaaggataagctgtactcctcgcgtaaatactgcaagagattatcaagctcaacttccatccggccgagttttacctcttcatctttcagaatgtccgttttttgcttgtacagacgcttcatctctttcagctcaagctcgttcgtatcaagagcccgctggagcttcacacgctggtcgcgccggctggcgatcaattcgatcgttctcgttttatcgtgaagcttatgatgggctgcttcttcaagctgctcctcaccgcttgtgctggacgtcatctctgaggtcaggaggcttaaatcttcccgtgtttctttcagagcgagctgcgtttcttcaagctcttttttcagccttttgaggttgtcttcctcactcgagcacgcctgttcttttttcgcagcggccactttacattccgtcagttcatgagagagcgtttcttttgttgaggatagggtctgcttttgttttgtcagcctttccatctcttcctcaagctctttcagctggccggatgcctcactcagctgttcttccagagctgatttgcgcgtctctttttcccggctgctttccgtcagtgatgctttctcctggtcgtaaagctccagatgggtattgatgttcttttcagcaacttcgagttcatacagcctgccttttacatcctgctgctttgttctgaaagcctcaccgtcttcacggagaccgctcagcgtatgttcaagctcttgaatggcctgcttcagcgctttgacctctttttcgagcagagctgttttttcttccatttcggcaagccgcgcagtcaccgtctcaagctcgcggcttctgccgagcagagaattgtttttctttttgaccgcgccgcctgtcattgatccgcctggattgacgacatcgccctcaagcgtgacgatgcggtagcggtgcccgagaagcttggccagttcattcgcgccttttaaatcttcagtgatcagcacggtgccgagaaggttttgaatgacattccgatacgccgcatcatatgtgacaagcccgctcgctgtgccgaggaaagacggatgctttgaagccgtctgttcatcacgggtttgaagctggcgcggtttcataactgtaagcggcaggaacgtcgcgcggccgaaggaattctgttttaaatattgaatcgctttccgcgccgcctgctcatcgtctgtgacaacgtgctgcgccgctgcgccgagtgcaatctcaatcgccgtttcatatttttgttcggtcgcaatcagttcgagaacggcgccgcggatgccgccgagctgctctttctgcttcagcacttcttttacgccttggtaaaatcctgaaaaatcgccttgcatcgtttcaagcatatcttttttggatctggcctgctggacgaattgatatgcctgatacagcgctgattctttcttttcatactggcgttttttctgttcatatgctgtctggacttcgcgaaagcggacgacctgattgtgaatatcctcttcaacggcggccaattcctcttcgcacgccgctttgcggactgcaatatcgttacgttcttcaaggtatttttcattgtttgcggtcagtctcgcctgctggaccgcagattgggacatctgatcatctaaaagctgcagctcgttgcgaatcgacgcctggctgtttaacaattcaaagtaatcgctttttaattgttcgattttctcttctacattttcattatgcagactgagagcctgctgcttttctttcacctgggcgtttaaccgcttcacttccgcacgaagtttatcatagacggcagactgtttttcaatgtccgctttcagttcggcttctttgttcgtgtaatgtgtaacggattcctctagctgttcccggttttgcgcggcgttttttttgcgctctttcagcacttctttccggccttccagcttttccagctcttcacttgtcacgagcagcacctgctgcagttcgttgacggattcatcaagcgcgtggattttatctctcgtctcttctatcatcgcttcttttgcggacagagctgatgattccgccaattcttcttgttttgccgtctgcaccttttcttttaaacccgaccatctgctatgcagttgttcgatgtcaaaggcggtaagggcgatttcgacatgctcaagctctttctttttttctaagtagtctttggcgattgatgcctggattttcagcggttcgacctgatcttcaagctcgtggagaatatcttccaccctgtttaagttatcctgcgtctcaaacagtttgttttccgcttttttctttcgtgttttatatttcagcacgccggccgcttcttcaaaaatactgcggcggtcttccgctttgctgctgagaatctcttcgactttcccctggctgataatggagaacgcttcttttccgagcccggagtccataaataagtcaatgatgtctttcaggcggcactgctgattgttgatgagaaattcactttctccggaacggtacacccgcctcgtcacgctgacttcgtgataatcgatcgggagaaaatgatcttcattatcaagcgttaacgtgacttcggcaaggttcagccgcttgcgcgaatcacttcccgcaaaaatgatatcttccatttttccgccccgaagcgagcgggctgattgttcgccgagcacccagcggatggcttcggtaatgttgctctttccgctgccgttcggaccgacaacggccgtgacgccttttacaaagtcaacggatatccgttctgcaaatgatttaaatcctataacgtctaaacgtttgaggaacatcccagatcctccttatcgtataagtatctcaatattatcataatcacccgcttatatcaggcgcagacatactgaaatcccctagggatacagggggattttattgtttcgtatgatgtttttgcaattttgcaagagcttcctgtgccgcatgctgctcggcttcttttttggaacgtccgttcccgataccgagcgcctcacctttaagagagacgagcgcctcgaattcccggttgtgggcaggccctttttcattgagaattttgtactcaagcgatccttttccgtcccgctgtacaaattcttgaagctggcttttgaaatccatcacatgagaaaaagcaccatcgtttattttagggaacacgtactctttcaggaattgctgaaccggctcaaggccctgatccagatacagtgcgccgataaacgcttcaaacacatccgctaaaagcgcaggacgctttctgccgcccgtcatttcttctccttttcccaagagaacaagatcgccgaatgacaattcgtgggcaagtgagacgagtgacggctcgcatacgatagcggctctcagcttcgtcaaatctccttcactcatggccggatatttggcaaataagaattgggagatcgtcagttccaaaacagcgtcacctaaaaattcaagcctttcgttgtcttcatacggctttttccgatgctcattcacataagatgaatgtgtaaatgcttgatacaaaagtttctcgttttgaaaatgaaccgaaatccgttcttggaactctttaaattgctctatttttttatagaacttttttttatctttaaaatgtgagtgttttgacatagtaacctccataggcacatcaggttcaccgcgctccccgccgtaaacggaatcagcagcgcgtacagcgtcagacgccggtaaccgaacgattaaagggctaaagccccgctgtcaggcgggacttttagcatcagcttattgctggttttgtatgtagttcacagcgtcgccgactgttgcaatcttttcagcatcttcgtcagaaatctccatatcaaactcgtcttcaagttccataacaagctcaactacatctagggaatcagcacctaagtcttccttgaaagaagcttcaagtttgacgtcagcttcatcaacgccaaggcggtctacgatgattttcgttacacgctctaatgtatctgccatagcaattcacctcccctcaagtattatagaggattcgtttttaaaaaactagagaaactaggatgaaattttaaaaacaaatctttacatcaccattccgccgtcaatatgaagggtttggcccgtcatataacgcgatccttcagaagcaaggaacgtaacaacgctgctgatatcggaaggatcaccgaaacgcgcgagcggaatctgcttcagcatttcatcttggacttctttagaaagcttgtccgtcatatccgtggaaataaagcccggagcaatggcattgaccgtaatatttcggctcgcaagctctttggctgatgacttcgttaagccgattacaccggcttttgccgccacatagtttgcctggccggggtttccgctgacgccgacgattgatgatacgttgataatccggccggagcgctgtttcatcatctgtcttgtaacggctttcgtgcagttgaatacaccttttaagttaatgttaatgacatcatcccattcattttctttcattctcatcagaagattgtcttttgtgatccccgcattgttcacgagaatgtcgattgaagaaaatgcagcgacagcctctttcatcatgttttgtacttcttcggaatttgatacatcggcttttacggcgatcgcgtttcggcccaaagatttgatctcatctacgacttcgttcgctttcgcttcattcccggagtagttgactactacattacagccgtttttcgcaagatcaagcgcgatcgcccgaccgattccgcgggacgctcccgttaccactgctgttttttcattaagcatcctgattctcctccttcagcgtttgaatcgccagttcgatggtttcatggtcagaaaccgagattgttttaaggcggcggttcacttttttcacaaggcctgaaagcacttttccgggcccgatttcaacaaacgtcgtgacgccttcgtcaatcagtttgttaatggtttcttcaaagcgaacaggcgaatacagctgttcgatcagttttttcttgatatcgtctttttccgtcataacgtcagccgaaacgtttgaaatcacgggaacagccgcattttttaactcacaggcgctgagcacctcctcgagtttttgcgctgccggcttcattaattcagaatggaacggtccgcttacttctaatgggatcgcccgttttgctccgttgtttttcgcttcctctgaagccagctccacgccttttgccgttccggaaatgacgatctggccggggcagttcagatttgcaagctgtacgagatgaccgttttccgtcacttgatccgtcacctttttcaaggactccgcatccattccgagaatcgctgccatggcgccttctccggccggcacggcttcattcatgaattctccccgttttcttaccgtgtaaacggcatctttaaatgtcatcgctcccgccgcaacaagcgccgaatattctccgaggctgtggccggcggtgaaatcaggggtgatgccggattctttaaacttttccaatacggcgatgctcgttgtcaacagcgcaggctgcgcattgtatgtaagggtcaattcttcggcgtcaccttcaaaaatgagcgagctcagctttgtttcaagcgtttcatccgcttcatcaaaaatacgttttgacgcttcttcgcgttcgtacaggtcttttcccatgccgatatattgtgatccctgtccgggaaataaaaatgcaatcttactcatgatgcggtaacctccagactactcatctgttttttcttcttttacttcttcttctataaatgcggccacgttttggctgaccatttctctcgcctggcgcagcgcatggtaaacagcgcgtgcgtcagaagagccgtgcgctttaatgacgggcgctttcaaaccgaaaagactcgccccgccgtactcagaatagtccattttcagtttcatttccatcagcttcggctttagcacgcccgctgcaagcttagaaacaaaacttgaagtcagtgtatctttcagcattttgaaaatcgataacgctgaaccttccaatgttttcaacgtgacgttgcccgtaaagccgtctgtgacgatgacgtcagcagcgccttcgagcaagtctctcgcctcaacgtttccgacaaaattcacgtttgtttcttttaataattcaaacgtcttttttgtcaggtcgtttcctttcttttcttccgtgccgacatttaacaatccgacgcggggcgagctgattccgagaacctgccgggcataaacagatcccataattccgtactggacgagatgctccggtttggcatcgacattggctcccacgtccaaaagaaggaaaccgtcgcctgaaacggtcggaagcgtcggcgcaagcgcaggccggtcgattcctttaattctgccgacgataaacagtcccgctgtcatgagtgcgcccgtattccccgctgagatgcaggcgtccgctctgttttcagccacttcctgcgccatcagcaccatagaagagtttttctttctgcgtacggcgcggaccggttcatccgtcggttcaatcacttcatcggcgtgcaacacagtgatgcggtctgatgttgttggcaagtgtgattctatcgttgtcttgtcaccgaccagcgtaatatgaagatcgtcaaatgcctcaatactcttcattactccgtcaataacagctttgggtgcgttgtcgcctcccattgcatctacagctattctcatgcatgctccacctttatgattgttttgaacggtacatgtcaaagctgccggagaacacgacttcttctcccacatagctgttgacttcaactaccgttctgcctttttctttttcgactgccgtcactttggctttcgcaacgacgcgctcgccttctttcacctgtcttgtaaagcggatatttgcgcttgcggtcagcgccagctcatcatcaatgacggctacggcgagtgagttcgcctgcgcaaacaaatgatgcccccgcgcaatttgattgcggctgaagacatgttcgcgtcttacttctaatatggaaatggcctggccgtcaagctccagatcaatgatttcaccgatcacttcgtctaaagacaatgatttcacttcatcatcaagcgtttgttctgccacgtttttaattctttccctcagctccggtattgagagctctaagcggtctaaacggatcgtctgaatgctgacgccgaatttccccgctaattcttcatctgtgatgaagggtgtcgatttgatcgtctgctgcaataatttttggcgttctttcttgcttcttctcatctgtaaacaccatccggacaattaagactaggtactaatagtagtatataatctcatagattggaatgcaatgattgttttttgaaagccgccgaattttacagaatcagcttaatttctccccttctaggacgccgcttgaaagtaattgaccgcgcagcatgcggtattcgtcatctttccaaaaagcctctgaagacaccagattggccgcatcctggcgggccgtttccaaagctctgtagtcatgaaccatatccgccaccttgaactcgggcataccgctctgtttttttccgaagaaatcaccggggccgcgcagttcaaggtccttttcagacagctcgaagccgtcgtttgtctctgacatgattctcatccgttccttcccggtttcggatttcggatcggccatcaagatgcagaaagattggtggtctccccgcccgacccggccgcggagctgatggagctgagataatccgaaacggtcggcgtcatagatgaccataatcgtcgcattcggcacgttcaccccgacttctacgacggttgttgacacaagtacctgacattgattggcgctgaattctctcatcacttgatctttttcatcagaatggagcttcccgtgcatcaggccgacattccatttaccgcggtaaacgtcagacagcatgttatatacgtcaatcgcattctgtacatccagtttatccgactcttcaatgagcgggcagataatataggcttgccttccctgcttcagctctttttctataaaagccaaaatccgctccagcatgtcgtgtttcacccaatacgtttcgatttgttttcgccccgcgggcatttcatctatcacggaaacatccatttctccgaagacggtaatggccaacgttctcggtatcggggtggctgtcataaacagcacatccggatcttgacctttattcttgagttttttgcgctgttcgaccccgaaccggtgctgctcgtccgtaataacaagactcagcgctttgaattccacttcatcctggattaaagcatgggtccctactaaaatatcaatctctccgagagcaagccgctccaaaagctccctgcgccgctttccttttacagaactcgtcaaaagcgcgatatttacatcttcatttgcaaacaacgatacgagagaatctgcatgctgttcggccagaatttcagtcggcaccattaatgccccctgatgccccgacagaatcgcagcgtacaaagcgatggcggcgacggccgttttccctgaaccgacatcaccttgcagcagacggttcattcggtaaggggatgtcatatcagcggtaatttcccgaagcacgcgcgtctgtgcggtcgtgagcgaaaacggcaggctgtctgtgaaagcggtgagcttttcagcaggaaacacatggctgatgccttttgactgttccctttccgctttacggaacgcctgcattttcagctgaaataataagaattcctcataaacaaaccgtcgtcttgcctgctgtaacgattccctcgtttcaggctgatgcatcgtctgcagggcatgtttgtaatcaggcagcttatagcggattctcaatttttcaggaagcggatcggccgcactgtccaaatgatgctgcagcgcttccttaataaaccgtctcatcatttttacggtgacgttttctttaacggaataaacaggctcaatgcttttatcttcttgatgaggaccgttttttaattcctgcacggaaacggtctgtctgtgtttatcccatttcccggatatcgtgacgacagaacctaacgtcagtttcttttttaagtagggacggttaaagcagaccgcggtaattaaataattgccgacaagcaccctgaatgtcagcctgtttcgttttttgccgtaataggtaagagaaggttctgaatgaaccttcccttctaccgtcactctttcttcatgttttacttcttctaaatccctcagctcatagtcgtcataacggtaagggaaataattcagaagatcagaaatgtcatagataccaagttcgtgcaatgttttttctgtttccggcccaatgcccttaatttccgctatactagtttgctgatggtgtgtcacttgatttcagcgctcctccgaaaatttttttctctaattctcttcccgtcggtgtcgcagctaaaccgccttgtcccgtttcacgcagtgctgtcggcattgtctggccgattttgtacatcgcgtcaatcacctcatcgcaaggaatgcggcttgtaatcccggccagcgccatatccgccgcgatcatcgcgttggatgctcccattgcgtttcgtttgacacacggcacttctaccaatccggcgaccgggtcacatacgagaccgagcatatttttcagtgtaatcgccattgcttccgctgattgctgaggcgttccgcccgccatttccacaatcgcggccgctgccatgcctgatgctgacccgacttccgcctgacagcctcctgccgctcctgaaatactcgcattatttgctacgacaaaaccgaacgcgccggctgtaaacagaaaacggatcatttgttctgtcgtagggttcagcttatgctttacggcgaataacgttcccggcacaaccccggcagagccggcggtcggtgtagcgcagatcgttcccatcgccgcattgacttcatttgtcgccacagctttagaaacggcgtctaaaatcagattgcccgaaaggcttcttcccgattggatgtatgcctgaagtttcacggcatctccgcctgttaaaccggtctgactcgtgacgcccttcagccctttttcaacagctgcttccatgacggagagattgcgctccattccttgaaagatttcttctcgtgttttttgcgtcacttccatctcttgggtgatcatcacttccgaaatcggaatttgtttttcttgagtgatttctattaattcttttacattacgaaacatgtcattttcctcctgactttttagtcagctatcttagtaacctgtataatattaggaagtgttgaaagctcgtcaagcacttcttcttcaatattctgatcgacctcaatcgtcatcagcgcaagctggccgacgtccttacgcgccacttccatatgtccgacgttgatggagaatttcgcaagcacattggcaacgcctgcaatcgtgccgaatttatcattgtgaacgactaaaatagccgggtggtttccggaaagtcgcagctcaaagccgttaagctccgtgatttctatttttccgccgccgatggaaataccggtaagggcaagctctccctcatcatcagaaatgacgatacgcgccgtattcggatgaacgggcacggcatcctctgtacggaactctacatatatgcccttctcttccgcaatttgaatcgctgttttaatccgttcatcaaatgtatcaaaatcaagcaggccgccgataatcgcgacatcagtgccgtgacccttatacgtttctgcaaatgatccgtaaaaagacacaacgatccggcggggctcacgcctgaataagcttctggccactctgccgatccgggcggcgcctgcggtatgtgaactggacggaccgatcatgaccgggccgataatatcaaaaacgcttctatacttcatgctggtttgctcctccttaacatcacttcattcagcgcttttctttagactaattgaacatttctcaattggcaagcaggcacactgccgcactgccgcaggtaaataaaggcataagaatagaagggcctgataagcccttctattctgccgcaaatatatatggatacagaggctgtctgccgttatggatttcaacctcgatatcttcacagacgctagcaatatactcagcgagtttctcagcttcttcttccggcgcgtcctctccgtacaggatggtgacgatttcatcttcttccccgatcatttcatccagcagcaatttcgccgcacttatccgatcttcggcgctgccgataattgaactgtttaaaatgccgataaaatcaccttttttaatttctttgccgtcaatatgggtgtctctgactgaatatgtcacctgtccgcttttcacattccggatggcctcaagcatattggcttcatttacatcagccggctggtcagggttaaacgcaagcagggcggtcatgccttgagggaccgtttttgccggaatgacaatgacattttcttcagctacgctcgccgcctgattggcagccatcacaatattggaattgttcggaagaatgaaaaccgtctccgcattgacagactgaacggcttcaacaatatcttccgtgctcggattcattgtctggccgccttcgattacgtgtgaagcgccgatgctcgtaaacaattcagaaatgccctctcccattgccacagtcacgatgccaaaaggcttgcgggcttctttcataacgccggccggctttttttcatcatgttcttggctgatgattgaagtatgctgttccctcatgttttcaattttaattttaatcagatcgccgtaacgctgtgcgagattgagtacgttcccaggttcttcggcatgaatatgaactttcgccagcgtatcatcagccacgaccagcaatgaatcgccgaaacggctcagttcgtttctgaacgcctcttccttgaacgtccgtttatcttgatccagcctcaccattacttccgtacaaaatccgaattcaatgtcttctgtactcagcatgctctgcgcgcttttatgatgctcggcattcaccatatcatcgagtgccggaagaaccgcttttttcggtacggcctctccttttaaagcagccaaaaagccttcatatacacaaagcagaccttttccgccgctgtcaacgacaccgacgtcctttaaaacaggaagcagatccggcgtgcggttgagcgacgcttccgcttcttcaataacggcctccatgactgaaataatatcggtttcttctttggccgaggcgaccgcttttttagccgcatccttggccacggttaaaatcgttccttcaaccggtttcataaccgccttatatgccatatccactcccgcttggagtgctgcggcaaactcttgggcatcaatttggtttttgttttcaatgctctttgtgaaacctctgaacaattgggacaagatcacccctgagtttcctctcgctcccataagcaggccttttgacagggcgatgccgactttgccgatgtcgggtgagtcaatgtgctctacctctcttgcaccggatgacatcgataaattcatatttgttccggtatcgccgtcaggcacgggaaacacgttcagcgcatccaccgcggatgcgttttgagacaatgtctcagccccgccagaatcattgccgcaaaagctctcccatctaagtttcgtctagacaatactcatcctcctcactacgggttcgttactcgtacgccttggacataaatatttacagaatcaactgcaagtccgattgtttgatttactgtgtattttaccttcgtctgaacattgtgggctacttcggatattttagtgccgtagctgacaataatgtacatgtcgatatgtatttgttcggcttcctgacggacatgtacgccttttgcgaagttctctctccggaggatttcagacaaaccgtctttaatctggttttttgaggccatccccactattccgtaacagtcaatggcagcgcctccggcaaccattgcgatgacttcgttggatatatcaatctgtccgtattttgtcttcatttcaatggacacacaggttcctccttcaggtgcatagagttatcattattctactatatgtatcccattatgaaaagaaaagatacagacagcggccttcagcgcggaaatgtgattggttttacatgtcaagtgatttttcttgaaagtaagggaaacaatagttgcaaacggtttttagctgtggtaaattatttaaagtattgtataacgaaagcatctgagacactatgtttaaaaagatgtttcgcgcagttaggagggaaacaaatggcacgtaaatgttttattacaggtaaaaaaacaaaagccggaaacaaccgttctcacgcaatgaacgcttctaagcgtacttggggcgccaaccttcaaaaggtccgcatcctcgttgacggcaaacctaaaaaagtgtatgtatctgcccgggctttaaaatccggtaaagttgagcgtgtataagcaaaaatgaacgcctgcccttttatgcggcaggcgttttttatgcgttcaaagagggcgatttcagcttcttgggcttactcttttctaaatgagcccagcatcgcccggacaattcctcctaaaaacttcggcaatttaatggtataaaatttcattttgtcccctcctataagtcccgtatccgctgcgttcatcactttaggattcatggttttttccgcatatggcagaagccgcttttctaatccgcgctccttaccattattaatatgccttttgcaaacgaaaaagtacctcgtgaatgaatgagttcgttactaatacatagtgtggaacccagaggaatatgacaattatcaaggggatatttaaaaccgtcgagtgtcaggccgtctgccgcttccgtaaacggaatgaaagaaatatagcgtctgcgcgctttttcttcaattgtataacggccgggcccgaacatctgaatgtcattctgccggtcgatcagcttgacatcggtatgcttatgtaaggctttatacagcagctggatgttccctaaaaagtgatcggctcttccgcccgtcacaccgaatacccgaatgttttccggttctttttgtaaagcccagtcaagggcgagttcaagatcggtataatctttttccgcctgatacacatggagggccggcgccgctttttgaatctgcatgagctcctcttccgtaatgctgtcaaaatcaccgaaagcttcctgcggaatgattccggcctccaaaagagcaaccgtccctttatcaactccgacccacgtcgtatctccgtctgtgtattcggatagatcgggaataagctcccgcgggccgcccgcaacgatattgattgtcttcatatgctatcctctctcttagacgcgaaaagagccggcggctttcaccgggctctttttcagcatgtttatgatgcgtttcggatgtcagcgatggcttttttccgatccggctgattatatacggcagacccggcaacaagcagattggcgcccgcttcagcgcataaaggggctgtttctttattaacgcctccgtccacctcgattaaaagctcagacaggcctttctcctcagccagctgtttgacctgacggattttcggcagaaccgaatgaatgaagcgctgtccgccaaaaccggggttaaccgtcattaacagcacaaggtcaagctcctcgatcacatgttcaatcatttggacgggcgtatgcggattaagcacaactcccgcttttaccccctgctcttttatcaattgaatggtccggtgaagatgcggacacgcttcagcgtgaacggaaaggatgtccgcaccggcttttgcgaatgccgggatgtagcggtccgggttttcaatcataagatggacatccagcggcagatcagtcaccggacggacggcttcaacgataagcggcccgattgtaatgttagggacgaaatggccatccatgacatcaatatggatatagtccgcccctcctttttccacgtctttaatttcctcgcccagtgaagcaaaatcggcggaaagaattgatggcgcaaccttaatcatattaatacctcggctttctctcttttatttcctgcataaattctttgtaatgctcgtagcggtacggctgaatctctccttcttccaccgcttgctttaccgcgcatttcggctccttaagatgcagacagcctctgaatttgcaggaggcgcttatttctctgatctcagggaacgtgctgcccagctcttcttcctcaatgccggtaaattcaagcgaactgaaccccggagtatccgcaaccagaccgcctgatgtatgaatgagctccacatggcgcgtcgtatgttttccgcgtcccaaatgcgcggaaatctcgtttgttttcagctcaagctccgggctgatcgcatttaaaagcgaagattttccgactccggactgaccggcaaacaccgtcgttttgtcctcgaagtgtttcacaatgcctgttaagccgctgttttcttttgatgacgtcacatatacgtcataaccgatcgcctgatagtctttcacgtaagaaagtatcgcctctttcgattccccgtctgcagctaagtccattttggttatgcagatgatcgggtgaatgccgttggcttccacaaggacgagaaaacggtccaataaagacgtgctgaacgccggctgaacggcagaaaagacgagaacggcctgatcgacatttgaaatcggcggcctgatgagctcatttgttcgttctttgatttccagcaggtagccttctttatcattttcagcctgataaacggcataatcgccgaccaggggcgttattttattttttctgaaaatgccccggcctctgcattgaatgatcttgtcctgtgattcatccaagacataatagaatccgcttaacgcttttataattttgccctcaggcatagggtccctccttatcagtcattatctttcgggtattcaatcgttttgtagctgacgactttatgatcgaccatcacttgataataccccttctgtccctgatcaatcttcagttcaattgttttttcggtcggctcttttattttaaatgagtcatacgtatcagagatgctgtggtccttatcatcgatggcgatttgcacttcaagctcttccccttcatgttcgggttcgtaaggaatgctgattttttcttttaccgttttcgccggtttttcttcaggtccgagcgagaacgtcacttcaacattacttcccggcttaaccgcagtgccggctgacggctcttgtttcatgacttgtccttccggcacgtcatctgaatgggcttgtttttcaacaagctgcaggccgttatcttcaagataccctgaagccgcttctttgctgtaagtctttaagtccctcagcgtaacgtccgccgggccgaggctgaccgttagattgacttcatcatcgcttgcgaccatatcggtgccggctgacgggtcctgatcaattacggtgccggcctcgctgtcatcgttttcttctttgacattgacatgtttgaaacctttttccttcagcgctttttttgcgtcgccgatctgccgtcctttcacgtcgatcagctgggttttcggttttccgatgcttttgtacagttttacagaagagccttctttaacggtagaccccgcttttgggtccgttttgaccattaattcctcttctattttttcatcttcaatatccgttatatcaggatcagcccggagcccgttcttttcaagcagggcttccgctttttcgtacttcatgccccgtacgtcggggacgcttacatctttaggcataaataaagacgggaacacggtgaccgcaagaacagccgccataataaaaatgaaacagacggccagcaaaacccacggccatttccgttttttctttttggctggctgctgttccttatcatccgtctcccccggcgtttccgcctgagacgcggcttttgggccgtcagtaataacgggaatggcttttgtcatttcctcatcatcctgcacggaaaatttttgttcattcagcctgccggcgtcaaaagccgttctgatgtccgcctccatgtcctcggcgctttcatagcggtgaaacgggtctttggcggttgcctttaaaataatgttttcaacgctctgcggaatggaagggttccactttctggcggaaggcgtttctgtttgcaggtgctttagcgctatgctgacggctgattctccgtcaaaagggattttgcctgttaaaagctcaaacagcacgatgccgagcgcgtaaatatctgattttttcgttgccagaccgcctctcgcctgctccggagacaaataatgaaccgagcccagcacagaattcgtatgtgtgattgtcgtagacgtaagcgctgtggcgatgccgaaatccgtcaccttgatatgccctaaatgatctatcaatatattgtgcggtttaatatcccggtgcacgatatggttttgatgggcatgggcgatggccgagacgatctgctccataacggacagcgcttctttcggatgaagcggtccgtgtgcgtttatgtattcctttaatgtcatgccttccacatattccatgacaatgtaataaatatcgccttcctccccgatatcgtaaatactgacgatattcggatgatcgaggcttgatgccgactgtgcttctcttctgaaacgcctgataaaatcaatgtcattcacaaagtcaaaccgcagaattttaattgcgacttcacgttcgagaatgatgtcctcagctaaaaaaacgtttgccattccgccgccgccaatgggccggaggatatgataacgcccgctgatccgcttgccggttagcacttgtcttcaccctcttttgcatctgcggaaaactcaatcaacacagccgtgatgttatcttcgccgccgttttgatttgctttgctgatgagaaggtctactttttcctgatgatcagattcggcttgaagcatttgtttgatctcgtgatcttctattttatttgacagtccgtcagagcataaaagcagctgatcgccgtcagacagttcaaaagaacgggcgtcggggctgatggtttcatctgtccccagcgctctcgtcaatacatttttccgcggatggtgctcggcgtcctctttcgaaatctcccccgtcttgaccagctcattcacaagcgaatggtcctcagtcagctgagtgaattccccctcttgaagcaggtagcaccggctgtcaccaatatgagccacagtgacaaacttccccgtgaataaggcgcagacaatggtggtgcccattccccggcattcttcattggctttagcgtggtcatgcactttgacattcgcctcatgaatccggtctttcagccaatcctcgcaagcggacggcagagaaggaaccgtttcggtccggttccactgctcttccatcgccgcaaccgccatcctgctcgctacatctccggcaagatgaccgcccatgccgtcggcgacaaccgcaagcaccgcgtcttcttttgtgaaaatgcccgccgcatcttcattatgccggcggactttacctgtatctgttttcaaggctgtaatcaacctcttcacctcgtctcgtcttgacgctccttcgcgcgaagctgaccgcaggccgcgtcaatgtcatggccttgctctcttctgatcgtgacatttacaccgcgggattttaacgttttttcgaatgcgaaaatctgatctctcggtgtgcggacgtaatcccgttcaggcacatagtttaccggaattaaattgacatggcatttcacgtcttttaacagttctgcaagctcttctgcatgttcgacctgatcatttacgccgccgaacagcccgtattcaaagctgatccgtctgcctgttttctcgatgtaatatttgacggcctccataaggtcaggaagcttataggctttgttaatcggcatcagacggcttctgatttccgtattcggagcatgcagagaaatcgcgaaattgatctgcattttttgatcggcgaaatcgtaaatcttcggaatgattccgctggtggaaactgtgatatgacgcgctccgatgttcagccctttatcgtggttaatgatttttaagaaagcgagcatttcattgaaattatcaaacggctctccgattcccatgatgacgactgagctgacgcgttcatccgtttcatcaagcgccttttgcactttcacgacttgagcgacgatttctcccgcttcaagattccgtttcagaccgccgagcgttgacgcgcaaaatgtgcagccgatccggcagccgacctgtgtcgttacacatacagaattaccatactcgtgtctcattaaaaccgtttcaatcgtataaccgtcatgaagctcaaataaaaatttcatcgtgccgtcttgagatgtctgttttacagccgttttcagcgttgtcagcacaaaattgctctcgagtttttcacgcaggctttttgagaggttcgtcatttcatcaaatgaagaaacccgcttttcatagagccattcaaaaatctgtgctgcgcggaacggcttttcgccattctcggtcagccattgtttgatttcatctaattcaaaagagtaaatggacggctgctcagtccgcagctctttccgtacgcttgtcttttttaattgtgtcatttttatcccttctttctcatgctgctaataaagaaaccgtctgttccgaaataatgcggaagaatttgaaggcttccatcctgaacaaagggtctcgccttttcaggcagccgcttttcaagagacaaatcgggttcaaactcagggtgttcttgtataaacgcatgcataacttcttcattttctgtccgatccattgtacacgtactgtatacgagtgtgccacctttttttactaatggggcgatttcccttaaaatgccgagctggatttctgacagccgtctgctgtcctccggcgtcttcgtatatttcatatcgggttttcttctgatgacgccgaaacctgagcaaggggcatcaacgagaatacggtcaaaccgttctgcgccaaaggcctctcccgcttttcgcgcatccatcgtttgcgcgtcgatgatcgtaagaccgagccgttctgcgccctctttaatcagcttcactttatgacggtgaagatcaagcgatgtgaggctcccctcgttctccatcagttccgcaatgtgagccgactttccgcccggtgcggcgcatgcatctaaaacggtttcgcccggcttcgggtccagcgcccgggcgacaagcattgagctttcatcctgtatggatacccggccgttttggaaaaatgccgtgttcgcgatgcttcctttcaaaagcttaatcgcatcaggagaaaggtctccggcttccgcttccagaccggcattctccatctcattcagcaccgtttccctgtcgctctttatgtgattgacacggagcgtctgcttcggcggaatgagatgaatccggcagattttttcagccgcctcaaagccgtacgcctcgacccactcttttacgagccattcgggatggcttgtctctgtagaaagacggagaaccgggtcttcaatttcagcaaatgacggcgccccctcacgctgcagggagcggagaatgccgttgacaaaggacgcaatgcccttatgcccgcgttttttggcgatttcaaccgcttcatggatggcggcgcgatccggaattttttctaaatactccatttgatacgcggacagacgaagcagctgaatcacccacggcttcaccttattcggcttgcggataaaaggcttcagcatatagtctaaggcgattttattttgcagcgttccgtagacaagctctgtcagcagtcctctgtcctgatcgctgagcgtgttcgttttgataaccgatgtaagaagcaggttgctgtatgcctgattttgctcaagcttctcaagcgcttcaagggcgagctcccggacattaattttcttcatttgctgctcctaacacgtcaccgggctgcacatttttgcctcttacaaaatcttcgcccttcatccgttttttccccgccggctgcagctcagtgattaaaagggcggtgctgtttcctgatgcgacgacaatgccgttttgctccgtgcggatgactgttccgggcgcagcatcagtttttgccgcaactttttcagaagcccatactttaatagtttgaccgttcaaagttgtataggcgacaggccaagggtttaaacctctgatctggttgtagatctcttctccgggctttgcccaatcaatccgctcctgctcacgcttaatgttaggcgcgtaagtcgcttttgattcgtcctgtttgatcggtttaatatttccggagatgacgttcgggacggtctctgacaaaagctttgcccccgctatgcttaatttgtcgtgcagcgtgccgacgttatccgtttcatgaatttccacttcgattttagaaatcatatcgcccgcatcaagcttttcaaccatatacatgatcgtcacgcctgttttcttcttgccttggagaatcgaataatgtatcggcgctccgcctcttaattcaggcaatagtgacgcgtgtacgttgatacagccgtatttcggaccgtccagcagctgcttgggcaggatctgtccgaatgccgccgtaacaatcaggtccggcttcaggcttagcactttttctatttcttcttcgagccttactttttcgggctgaagcacgggaatgccgtgacgttcagcttcagcctttacaggagggggcgtcatgattttttttctgcctttcgggcggtcaggctgcgtaacgacaccaaccacttcatatccgtcttcaataagcgtgcgcaggacgggaactgaaaagtcgggcgttcccataaaaacgatccttgtcatccaatcatccttccatttctgccagttcttcttcagtgtagtaagccgtaatttttgatgtgaataaaatgccgtctaaatgatccatttcatgctgaacggctctggccaaaaaaccctccgcttctaaaataaacggttttcctttacggtcgtgggcttttacctttacgtaatccgggcgggtgacatcaccgaaaaccccgggaaaacttaagcagccctcgactccggtctgttcaccgctcttttcaagaataaccggatttacaaggtcgatccggccgctttcttcaccgatgtccacgacggccgctctttttaaaatgccgatttgcggcgcggcgagaccgacgccatccatttcgagcatcgtatcgtacatatcgtcaagcagtttttttaattttttatcaaacactgtcacttcatcggcgggtgtttccagaacctccgccgggtgtgtgacgattttttttacagccaaaattttgccctccaaaaactaatgttacatcagcatgtacggattcatatcaattgaaatcattacatgcttttgcgcaatgtcgcgtttatagtgctccagtatctttttcaactgaatctgcaactcgttttcctgtctgtattttatcacgcattgatagcgatatctatctttgatcctggcaatcggggaagccgccggcccgagaattttcgtatcaggcccgcatcccgctcttaaatagtttgtaatcttttctgcggtgaccgcggcttttgccgcttcttcatgagaaacggtcaccagcgccacgtaataatacggcgggtatgactgggcccgtctgtgcgccatttcctgctgaaaaaaagtttcatagtcgtgcgttttcgtcagctgaatgctgtaatgagacggtgtatacgtttgaatgaccaccgttcccggcttttcatgccgcccggcccgtccgcttacctgtgtcagcagctggaatgtcttctccgcggccctgaaatctgggatgtgaagcgtcgtatcggcgcttaatactccgacaagcgtcacgttcggaaaatcaagcccttttgcgatcatctgcgtaccgagcaggatatccgccttcccttcaccgaacgctgacaacagtttttcatgggcgccttttcttgaagtggtgtccacatccatcctgatcacgcgcgcctgaggcagcactttggtaagctcctcctccacacgctgtgttcccgtgccgaaaaagcggatatgttcgcttccgcattccgggcatgttcccgggacaggttcctcatggccgcagtaatggcatttcagcctttgtccgtagcggtgataagtcatggaaatgtcgcaatgcggacattgcggcacataaccgcagtcccggcacatcacaaacgaggaatacccccgtttattcagaaaaaggacggcctgctctttttttgcaagcttctcttccagctgttccatcagctctcttgagaacattgatctgttgccgtttctcagttcttctctcatatcaacgagagaaacgtcaggcatgagctggcggtttacgcgatgttttaacggaagcagctcataaacgccttttttcgcccgcgcaaatgactccaatgtcggcgtggcgctcccgaggacgaccggacagctgtgatgctcggcccggcggatggctacgtccttcgcatgatatcgcggcatttcctcctgcttataggaagattcgtgctcttcatcaataatgatcatgccgagattttcaaacggggcaaagatggccgatctggctccgacgacaagccggacttccttgcgctgaatcttccgccattcatcgtatttttcacctgtggataatccgctgtgcatgaccgcaacctgtgagccgaagcggcctttaaaacggttgaccatttgcggtgtcaacgaaatttccggaacgagcacgatggcttcttgtccttttgccagcactttttcaatggattgcaggtaaatttccgttttgccgcttcccgtgacgccgtgaagcagaaagacgtgatggacatggtcggctacagcttgtttaatcggctcaaaagcggcctgctgctcttctgtaagagagagcggctctgtttttttgaacattctgtcctgataaggatcgcggtaaacctcctcaaagctttccgtaagaagcccctttttaagaagcgttttcagcgtcgcggaactggaatcggtctttttgcaaagttcagccgcggaaatcttttctcccccgccgataaaataagtaagcacggcgagctgtttagaagcctgctttgtcaatgaatctgcgtgccgggcgagttcttctttgtctgcccccgcttcaatcatgcggatcatttttttattcgttttttgggcgactttatatgtgacatcaatgcttcctttacgcacgaatttctgaagtgacgaaagaatgctttcatcggtaatatccgagtacagaagacttttttgattcctgaaaagctgtttgatgtccggtgtcagcgcttcttcgtcaacgactttcagctctttctcgtacttcgccttcaatgcggcgggcagcattgcctgaagcgccgtgattttaaacgacagcgttttgtcagaaagccatgaagacagctgcatcagttcctcagtcagaacaggcgtcaaatcaagaagcttctcgacttccttcattgagccgccgtttaattcggacgaatctttcaaaccggtcacaaatccttgaagcttgcgcgggccaaacgggacaatcacccgcatgccgacttcgatcatcccttttaaatgatcgggaattttgtaatcaaagggtctgtcaatgtttttggagctgacatcgacaatgacttctgctacattcatacgggttttcggtcctcggctttcaaagctgtcatttccttcagcatttcaaaggaaacgtcaagtttagacataagcgcaagctcccgttttcttccgtcccggaaatagaaggtgacgacattcgtatccgtgccaaatccggccccttccgctttcacatcattcgcaacgatcatatcaaggtttttctgttcgagttttctgcgcgcatagcgttcgacgtcttgcgtttcagccgcaaatccgaccagcagctggtgtgttttccgttcgccgagttctttcagtatgtctgccgtacggttgaattcgatcacgagcgaaccgtctttcttcttcattttgtgatcagaaacagccgccggcgtaaaatcggccacggccgccgtcttaatcaccatgtcgcatgaatcaaacacagaaagcacggcttctctcatatcggctgccgattgcacaggaagaaactgatacagcccgactggcggctctattgacaccgggcctgaaatcagcgtcacccgcgccccgagacggacggcggcttcagcagcagcgtagcccattttgccggtggatttatttgtgaagaagcggacagggtccacggcttcgcgcgtcggaccggccgtaatgacaatatgttttcctttcagcggcgcatcgtcttcaggctccttaaaatgctctctgacacgctcaacaataagctccggctcctccagccttcctttgccgacatatccgcatgccaaatagccttcactcggctcgataaagcggaccccgtcctgataaagcacagagatgttccgtttcaccgccggatgatcatacatatggacattcatcgcaggcgccacccagaccggggcctcagccgccagcaccgtcgttgtgagcatatcatcagcaattccgttggcaagcttgccgataatatttgccgtagcgggcgcgacaataattaaatccgcccagtcagcggcatcaatatgagaaatcaccttcggattttgttcattaaatgtatctgtatacacttcattccggctcagcgcctgaaatgtcagcggagaaacaaactcacgcgcggactcagtcataatcactttgacatttgcgccggcctgaaccagcttgctcgtgagtgcggaagctttataaacggcaattcccccgcttacgcatagcaaaatgtttcggtttttcatgaagtcttctcctcctttatgaaagcattggacaaatcccaaacggaaaaaaataacaacctatgtagagataggttgctacgtgtgcttgttattcgctgtcttctctttcaaacgaaagcaggcccgcgtcaatttcttctaaagctttgcctacatatttgtgagaaatggtatgttcaatctgctggtcctttttgatctgcatttcacgcgcgcgtcttgcagacacagtcaccagcgtatatttagaatctaatttattcattaaagagtcaattgacggatctaacataagttattctacctccagcattttcttatatctcggagcaacgcgttcacgttttaagtgctcggcgagaacgattgcgttaatcttatcacaagccgtttggatatcgtcgttttcaacgacataatcatacgcgtccatcatttcgatttcagcttttgcggcattcattctgttttcgattaaatcgtcggtttcagtccctcttgtcacgattctgtttttcagctcagaaagactcggcggcgctaagaagataaacaggccttccggaaatgcattccgcacttggagcgcgccctgcacttcaatctctaagaagacgtcttttccttcttgaagcgtctgttcgacataatcaacgggcgtaccgtaatagttgccgacatattctgcccactcaagcagtttgttgttttcaatcatgcgctcgaattcatctctggatttaaagaaataatcgacgccgtcgacctcgccctctctcgggtttctcgtcgtgactgaaattgagtattcaaatttcgtgtcctgttgtgaaaatattgcttgccgaaccgttccttttccaactccggagggacctgagagaacgattaataaccctctttctttcatgcggcaattacccctgcccttcatccataatttcttctttcacagaaagtctgtgtgcaactgtctcaggctggacggcagataagataatgtgatcactatccatgacgacaactgcacgggttcttcgtccgtatgtagcgtctattagcattccgcggtctcttgcatcctggatcattcgctttattggcgcagactccgggctgacaatcgaaatcatccgattggcggagatgatattgccaaatccgatattaatcagtttaatcgtcatcttctacgttccccctgtaaaatagacgtctctagtgtaacctgaagagaccgtctgtaaacaatacgcacagtcgctattctatattttgcacttgttccttcaatttttcaatagaacttttcatttcaacgacaagctttgtgatttgatgatcattggcttttgagccgatcgtgttcgcttcccggttaagctcctgaacaaggaaatcaagtttgcggccgactgccccgccttcttttaatatatcacggaattgaacaaaatggctcttcaatctggtaatttcttccgttatatcagaacgatcggcgaaaatggcgcattccgtgatcagcctgctttcgtcgagcgcgtcctccgtccattccttcattcgggcgtaaagacgctcgcggtattgaataacaacggccgaagcgcgctctttcacctgttcggacagcgtctcaagccgctcaatgtgcagaaagcagtcttccgccaaaagccggccttctttttccctcatgtcacaaagttcctttacagccagctcagcggcttccctgatgacttcttcaagcttgtcatcacgcatctgttcttcgtgaatctgcgcaatatgttcaaatctaaagaaatccattgcatcgggttctgcggccaggctgtagcgctctttcatggcgcgtgcggcgctcacatattcatcaaggagctcccaatcgatgttcaggcttctttttatgagcgcgtcactgttgacagtgagaaacagctctactcttccgcgctgtatatgctgcaatatcgtttgtttcagcttatcctctacatatagcaaaggccgtggcaggcgggcgttcacttctttgaaccggtaattgacggatttcaattcaacggttgccgagagatcgccttttgtgctgcttgcgctgccgaagcctgtcatactccgtatcatatgaaacacccaattctttcccgttatcaaaataaaagggcaatagacatgctattacccctaagattatatcatatggaattatttttttcttgtcaaaagtgaacccgccagcaaaaaagtaggtatgccagacatcccgataatcagcatccaatcgcccggcgtaatcggcactgttttgaaaatcggctgcagcggcggataatagatgacgatggccatcaggaagacagaagaaacgatggcgccgagcagataaatattttcaaacggattccgggagaaaacagacgtttcgctccggcagtcaaacacgtgtataagctgagccaggacaagagtcgcgaatgcaacggtctgtgcgtagggcagattttcaggattgcggtgatagacgatgataaacgctaaaatggttgcggctccgattaaaaaccctcttgatacgactttccagcccagttttctcgcaaacactccttctttcggatgccgcggcttccgcctcatcaggtctccttccggctgatccataccgagggccatcgccggcagcccgtcagtgactaagttcacccacaatatctgaatcgggacgagcggcagcggcagagcgagaagcatcgcaaacagcatcactaaaatttcaccgacgttggaggccagcaaataccggacgaattttcttatattttcatagatattccgtccctcttttatggctgatttaatcgtagcaaagttatcatctaccagaatgagagaagaggcttcctttgccacatccgttcccgtcacgcccatggcaacaccgatatctgcctgctttatggccggcgcgtcattaaccccgtctcccgtcatggcgacgacgtgtccgttttcctggaacgctttgacgattttcaatttatgttcaggtgacacgcgtgcgaagacgtagacatcatcgaccgtttcgataagttctttgtccgtaagctcattcagcgtcttgccgtccatcacacgcccctttttcggaagaagacgcaaatcttttgcaatggcctttgccgtttcgacgtgatcccctgtgatcataaccgttttaatgccggcttcacggcattctttaatggcctgtctgacctccggacggggcggatcaatcatgcctgacaagccgagcatcgtcagatttttttccgcctgctccattgtcggcttttctccgggcttaagcggtttataagcaatcgcaatcgtacgcaaagcttgcgacgccagctctttcagaaccgcttccgtttctgctttcttttctcctgaaaaaggcgtacttcttgcgccgtgcatcagatgtgacgagcggtcaatcagcacatcgggcgctcctttagtgatgacgaactgctttttttcctgatcctctacaatgacggtcatcattttgcggacggagtcaaacggaaactcggcaaccacgcggtaatgcccgctgagccaatcgtttgaatagccgccctttcttgcagccgtcagcagcgctccttctgtcggatcaccgtcgagtacataacggccgtctttcagtgcgatttcagatgtgttgcacaacgcgccgaaaaccagcatctgttcaagaatcttctcatctttcggcttgatttcccgctcatctcgggtgaaaacgccctccggcacatagccgatgcctgacactttataaattttgccgcctgaccacatatgggtgacggtcattttgttttgtgtcagcgtgccggttttatcagaacaaatgacagaggcgcagcccaatgtttcaaccgccgggagctttctgacaattgatttttgtttgatcatgcgctggacgccgattgataatgccaccgtaacaatggcgggaagcccttccggaattgcggcgacggccaatgacaccccggccaaaaacatgctgtaaagatcatgtccctgtaagacgccgactgcaacgaccaataccgttaaaaggagcgcgacgataattaaaattttgccgagctcttcaagtcttcgctgcagcggtgttgaaaggctgccggcggattccagcatatcggcaattttccccattgccgtattcattcctgtaccgacgacgacgccgacaccgctgccgcgcgttacgatcgtacccataaacgccatattgctgatgtcgcctaacgaaacatccggctttctcaatttatcggcttgtttaaccaccggaattgattccccggtcagcgccgattcctcaatttcaaggcttttcgcttcaacgatccgcacatccgcgccaatccggtcgccgcttgaaaatttcatgatatcgccgggaacgagctccttggactgaattttcttccagctcccgtcccgcaacgctgacacatacggcgttgacagctcttttaatgcatgtaaagacttttccgcccgccgctcttgaaaaaaaccgagaaccccattgacaaatacaatcgccataatcgctacggcatctacatattcgcctaaaaacccggatattaaggttgccgccagcagcacgagcaccataaaatctttaaattgggcgaaaaacacggcgatcgccggtgtcctcttgccctcctgaagctcgttcggcccgtgcttttcaaggcgttttttcacctctttttcggtcaacccctgtttaatggacgtatttgttgctttcagcaaatcggtttgtcccatttcatgaaacttcattcttctcgtccactcccctgcctcgctttagagatgtcactctgtaaacaagcttattctgactcgtcccttttcatgctataattatcgaatgcaggaagaaggaaagggtgttttatatgtcttttgatggcatgtttacatacggaatgacacatgaattaaacagccggatcgccggaggacggatcacgagagtccatcagccttttaagcacgatgtgatattccatatccgcgccaacggaacaaaccacaaattattattgtcggcgcatccgagctattcacgggtgcacatgacaaaccaggcctatgaaaatccgagcgagccgccgatgttttgtatgctgctcagaaagcatatagaaggcggatttattgagaaaatagaacaggccggattagaccggattatgatattccgcataaaaagcagaaatgaaatcggcgacgaaaccgtaagaacgctgtatgttgaaattatgggacggcacagcaatattattctgactgacggagaaggatccatcatcgacgggctgaagcatttatctccgtcgatgaacagctaccggaccgttctgccgggctatgattacaagcttcctcccgctcaggaaaaaatttcgccgcttgccgcggatgaagaggacgttttgcgttatctcagttttcaggaaggacggcttgaccagcagatcgtcagacatttctccggtgtttctccgctgtttgcaaaagaagccgtgcacagagcgggtctcgctaacaaaataacgctgccgaagacgctgattgaaatgttccatgccgtgaaagattgcaggtttacaccgaacattacgacagccggcggaaaggaatacttttatctcctgtctctcacacatgtaaacggagaggagcgcacctttcactcactgagtgagctgttggaccggttttatttcggcaaagcggaacgcgaccgcgtcaaacagcaggctcaggatctcgagcgttttgtcgcaaatgaacggaaaaagaatgccaataagataaaaaagctggaaaagacgctcgactactcagaaaatgcgaaggaattccagctatacggcgaactgctgacggcaaatttgtatatgctgaaaaaaggtgacaaagaagcggaagtcatcaattattatgatgaagaaagtaagacggtgaccatccctttaaatccgaacaaaacaccgtcagaaaacgcgcagatgtattttacaaagtatcaaaaggcgaagaattccgtcgaggtggtaaaagaacagatccgtctggccgaggaggaaatcgcttatttcgatcagctgatccagcagctctcctccgcctccacaaaggatattcacgaaataagggaagagcttgtggaaggcaaatatctgcggccgaaacagcagagaggacagaaaaaacagaagcagcacgttcctgttttggagcaatatgaatcttcacggggattgacgattcttgtcggcaaaaacaataaacaaaatgagtacttaacgacaaaagctgccgcgagggatgatttatggttccacacgaaagacattccgggttcccacgttgtgattaaaagcagcgatccggatgaacaatccatactggaggcggctgcgatcgccgcttatttttccaaagcgaaagattccggctccgttccggttgattatacaaaaatcagacatgtgaaaaagccaaacggcgcaaagcccggatttgtcacctatgacagccagcataccgtatttgtcacacctgatgccgaccttgtcatacggctgaaaaaataaacgcacctccaagctgaaacccgcactcggcttggaagtgttttttattacgtataaacggagacgaaactctcccagccgtcagaaccgatctttacagtatctgatcagtttcccgtcatgtctgcatgatccgccgggccgtctgtgatttaaacggtcacacctgatttggcggcggatactttcaccttccctcgccgaacctgagcacatccgggcgggtctctgacctttcctttgtatgcgggcgaaatccaggcggcatcgggatcacatacatattccgcatcacttcgcaatcctgaccgcttgtcggcatataccattcaaactgcccgctttcgttttgaatttttcacattcggcggactgtcaggacagtataaaaaacaccctgcctgatgacagacagggtgttttttatggtcttcttcttttctcaaataatcgatccacttcttcagccaaatcagcagtaatgagaggctttatgtcctcagccagtcttttcgtatgtgcagggcttgcgccgcttgttgatacggatacttgaatgcgccctttgcggatgatcttcggcatatacacgctgccccgttcagcctcgcttacacaattgaccagctgcgtttcagaagcgccctcggttatctcccgattcacgttgcggtcatttgtcgcggcaatgatgaaaaaagcgggcgcgagatccttcatgtcaattttacgggaaacccagcggatacgtccttcatccgccagctgtttaatttcaggcagggcatcgggactgattacagtaatatccgcgccttccgaaagcactgttttgagtcttcttaaggcaacattgcctccgcccgcgatgacaattctttttccgctgagattaatgtgcagaggcagcatactgtccccccttaaaatcaaactgcccgccggggtttcggacagcttccgtcacacggttcaaaaacgcctgcttaatatgcgggtgaaaacctaagtatgaagcgagatgaacattttgattgaccgtttgaagcttttgaacttcccgttcaatctcagtcattaaaagcccggtaaacagaagatatggaacgataaaaacgggtgctccgtcatcctcttcaaggccggcaaacacttctttatagtgcgggtcacatgctgttaaaaaacaagggatgacttctttaacaggtgtaatcgcctcaagttttccggcaatctcactgactgcgcttttaactgccggatctgtgcttcctcttccgatcagcaccactttcgcctgctcaatggacactccggtatcttcaatgcgatgatgcacggcttttacgacttcatcgtccactccgatcggaacaccatatgtcacttttatatcgggatgcagggccgccgcacgggcgatttcagccggaatgtcatgtttcgcgtgggcagcggtcaacagcagcaaaggcacagccgcaatatgagtggcgccttgtctgacacaagcttcaaatcccgcttcaatagacggttcctgcagttctaaaaaacagatttcctgaatgggagcgtcagcgtgtggcatgcacccttttaaaaacgccgccgactctgtctgcgcttttttcagcctgcttccgtgtccgatatataaaatcgcctgcttcatttacaacgcctcgctcaaatccggatttttctgatcagatgcataccagtccagtatgcagtgataattgacgacatcaccgataacaattaaactcgggtttttgatttcttcttttatcactgtgtctgaaagcgtgccgacggtgcagacgactgttttttgcctgtccgtcgtcccccaatgaataaaggctgccggagtgccgccgtctctgccgttttccagcagcattctttcaatctgccggatatttttaattcccatataaatcaccagcgtatcaatgcccgtcgccagcgctttccatttttcttcaaagtcgtcttcttgtttataatgccccgtaacgaatgcgacattggagctcgcctctctgtgcgtcaccggaatgccggcataagcagcagccgcgattcctgatgtaatgccgggaacgatctcaaacggaatggcgttttgcgcgagagcctccgcttcttcgcctccgcggccgaaaacaaacgggtcgccccccttgagccttacaacggttttcccctttttcgcatacttcacaaggaaacggttgatcgtatcctgtttcataatgtgaaaatccgggagcttgccgcagtaaatcagatccgcttcttctccggcgtactgtaaaatctctttgtttaccaatctgtcatataatataacgtccgctttctgtatggctttcattgccttcaccgttaataagtccggatctcccggaccggctccaacgataaatactttccccatagcatgtctccccgatccgttttgaaatcttcccagaacagccgcgaggccgcacttcagctattttaccatatcccgccattgcgggggatatccggctgattgcgcggcctttttggacctattatgctaagctgtttttcacaaagtcaaccagtcttccggtgcattcttcacgttcaaatttgcctgaatcaagtacgagctcaggcgctttcggctcttcatacggtgagtcgatccccgtaaagaacggaatttcaccatttcttgcttttttatataaccctttcggatcgcgcttttcacatatatcgaggtcgcatttcacgtagatttcattaaattcgccctctgccacaagctctctcacctgatctctgtcctcacggaacggagaaataaaagccgtgatgacgatggttccctgctgaacgaaaagcttcgccacttccccgatgcggcgtatattttccttgcggtcatcatcggaaaaacctaagtccttgtttaagccgtggcggatgttatccccatcaagcacaatgacttgatagccttgttcaaacagctcgcgcgctgcggcgtttgcaattgtggatttccctgaaccgcttaagcccgtcagccagaggatagagcttttatgcttgtttttctgctggtattcttctttcgttattgaggcttcatgccatacgatatcacgatttgtcactctattttcctccttaagaaacgcctgcttcttctttcgttttcagccctttaatcaacacctcgacaacttcaggacggctgaattccgccggcggcatgacgccgcttcgcagcatttctctgacctttgttcctgacagaatgacgtggtcttctctgtcatgcggacatgttttggccgttcccatgttgccgcatttctggcagaagaagctgtgctcgaatttcatcggtgtaattccgagttcatccgctgtaaattgatcaaacagctcttgcgcttcatatgtgccgtagtaatcaccgacgccggcatgatcgcggccgacaataaaatgcgtgcagccgtagtttttgcggacaagcgcgtggaaaatggcttctctcggccccgcataccgcattgccgccaaaaacacgccgaggaatacgcggtctttcggataataatgatcgagcagcacctggtagctttccattctgacatccgccggaatgtcatctgattttgtttcaccgacgagcgggttcaaaaacaggccgtcaaccgtctcaagcgcggttttttggatatattcgtgggcgcggtggaccggatttctcgtttggaaaccgacgatggttttccagcctttttcttcgaagcttcgtcttgtatcggcaggttcaaatgtaaactcaggaaactgctttgacgcttttttaattaatgtgatcggcccgccgacatacgtatcgccgcgtgaaaataattttttcacgcccggatgcgcggcatcatcggttttatatacgtgaacggcttctttttgtttatccggcgtataaatatcttcgatgtcgacgacgccgtatgtttctccgccgtaagtcagtttcaccgtgtcgccgacggcaagctcagccgctttttctgaatcgaccggaagcgtgatcggcagggaccagacaacccctgatgctagacgcatattttcaacgactgatacgtaatctttttctgtgaaaaatccttcaatcgggctgtaccccccgatcccgatcagctctaaatcagcgaacgaaatcaaatcaagctcaatttctttgtggacggatgtaagatcatactgctcattcacccgattaattaatgttcctccgtgcggtgctaaactcataatacatgattcctcccagttaacagataaataaactcagattaatagttaaatgcccccgccttgttcatggacagagcgtttctcttttcggatggctttcatcagactggcggctccgccagctgccaaaagcacgctggccatcataaagatggaatagtaatctccttttaacagcagggagacaagcagatacgaaatcgacagtgacaaaaacggcgaaacaacccatactttgagcatcgttttcacgacttctttatgaaaaacgttcggcccgtttttggccattccgataccgataattgatgatgatgtgacttgcgccaatgggaccggcagaccgaagacggaactgataatgacaagccccgcaccggttcctgaaagcagtatgccttctccggctgaaaacctcgtaatctttttcccgttggtttcaagcactttgcgtcctaaaagcagagcgccgagagcgacaaagatgcctccgtacagcgttccttttgacacgctgagtacgcccgcagccaccaaagggcccaccgcatttgcgacattgttcattccggctgaaaaagcttcccaaaaccccgcaaaaagcagcacaattcctaaaatcttctgtttccgtttcgaaatgactcgaatattcagagaactgaataccttcgatacgagaaaagtgaaacagaacgcgacgaacggtacgagcacccaaaaaatcacgatgaccaaaagatgctgtaaaaacaatactttgtacgcgacgccgacaccgacaatcgccccgacagtgacctcactcgtcgacagcggaatgccgagcacattcgccgtgaataacgatagcgccgccgctccgattataatgcagacaatggtgagcgtaatggtttgttcgggaatgattccgccgctgatcgtcttaacgacttcaccgccgccgataaccgcccctgacaggactccggccgcgcagatgatcagcgcatacgttttctttttaacggcgccggacccgtaagcgactcccattgatgccgcggctccgctggctccgatattcatggcaaaaaacagacagaataaaatagcggctaattccatcgggcagctcctttattcatgcagtccgcattctgttttcgccatgccgttccatctgccgctccgcaaatcttccgcggtaaacgcaggtgaagtgcacggttcacagccgatgctcggatacccctgatcatggaggatattgtaatccagctcatgcttggaagtatatctccagatgtctttccatgtccaatggatcagcgggcatactttaatcgattgaaacttgtcgtctttattcaggaaattcgtattcgcccggctcggcccttgatcccggcgaaggccggacagccatgccggatgccctgcgagcgcttctcttaacggcagaatttttctgatgtagcagcactggttcggttctctttcccacagtttatctccgtgagcctcggcctgttcctcgagagtaaggctgggctttttcaggataatgttcagccccggataacgttctttcactttttcgatcgtttcatatgtttctttaaagtgaagacccgtatcgagaaacacgatttccgcgtctttctttactttagaaattaaatcgatcaggacgatgccctcaatcccgaagctgcacgcgtaaacaagctggtctccgtagtggccgtatgcccattttaaaacggacagcgcgcctttataggaatcgtcttccggaaatgtaatcgccggttcctcccatgtatcatacgttagcattttttctttcctcctcccggagacaatcaaacagttgttgttctctgccggttgtcttatccctcaatctttttttcatataaaaaactttcaatccagcggaatgaaagacagtgacccggtatagcccttatcttcaaaatgctgtgcatttttctggatgcggcaccttgcaatacacgcaggttgccgggcgtcatcggtccagtccctcagccgctcttgataagctttttagatttgtactaaattttagcacaattctaacagaagtcaacccgagttttttgataggaataataaaacaggccctgaggcctgtttttattgtcattattttttaaaccaatcttttgactcgggattcagtttccatgatttcagtttttcaatgtcagctgaatgaatcgtaccgttttcaagcgcgacttcaatcagcgtgtcataatcggttaacgagtaataaggaagacccgcttttttaaaggcttctgttgctttcggcagtccgtatgtaaaaatggaaatgacgccgaggacttccgcgccctctctttgaagggccgccgcagcttcaagcacgctgcctccggtagaaatcaagtcttcaatcacgactgttttttgtcctttcttaatggcgccttctatttgatttcctttgccgtgcgctttcggtttgcttctgacgtagcacatcggcgcgcctgtacggtctgcgagaagcgcagcatgcggaatgcccgccgttgcagtgcccgcgatcatctccgcctcggggaaatgctccttcagcagtttgccgagcccgtccgccacatcatttctcacttttggatacgacaatgtcagacggttgtcacaatagatcggtgataaaatgccgctcgcccacgtaaacggctcattcgggcgtaaaaagacagcttcaatgtgtaatagatgttttgcgatagcctgtttcatcggcgaacgccctcccattccagtttaattgcttcatatgctttaacggggttttccgcttttgtaattgagcggcccacgacgatggctgacgaaccgttttctttcgcaaatgacggagtcgccgtacggacttgatcgtcagctgcgtcactggcggtgcggatgcccggcgtgactgtcagaaatgaaggccggaccgcttcataaatggcttttgtttcatggaccgaacataccactccgtccagcccgcactcttccgccattttgccgtaatgcacaaccgtttctaacagcggcttatgcagcagaagctcttccttcgccacctgctctgaagtgctggtcagctgagtcaccgcgattaaagacgggcgttttctgcctgccggcgtgccttcttcaagcccctcaagggccgcgcgcatcatgcgtgcgccccctgccgcatgcacattgacgagatcaacgccgaggccggccagccgcttcatcgctttattgaccgtagtcgggatatcatgaagctttaaatctaaaaatatatcacagttccgttcttttaattggtgaatgatggcggggccttcctgataaaaaagttccatccccgttttgacaaagagcctttccttttcaaacaagtctaaaaacgttaaagtctcttcccctgatgcaaaatcaagcgcgatgatgggcaggttgtttttcatgtttccagctccttccgatgcattcacttacagattgaaagccgtgttggcgcagcacgtgggggagctgttctatgatttccgggcagacgaacggattgacgaagttcgccgtgccgacggcaaccgcactcgctcccgcaagaagaaattctaatgcatcctctgcggtctgaacgccgcccatcccgataatcggaatttgaacggcctggctgacttcgtataccatccggatggcgaccggtttgatcgccgggcctgacagtccgcccgttttatttgctaaaatcggccggcccgtcttgagatcgagcctcatcccgatgagagtattaatcatcgtcagaccgtcagcaccggccgcttcaatcgctttggcaatttcggctatgtttgcgacattaggcgaaagcttcacatacacaggcactgcggaaacttctttcaccgcttttgtcagttcggccgccatgacgggatcagtaccaaaagcaatcccccccgttttgacattcggacatgaaatgttaagctcaagcgcatgcacattcggcgcttggctgatgtgctcggccacttctttatagtcgtccacctgagaaccggcgacatttgcgataatcggcgtgtcaaattgttcgagccaaggcagctcgtgattgagcacatgctcaaggccgggattttgcagtccgatggcattcagcattcccgcgcttgtctccgccactctcggcgtcggatttccgaagcgggcttcgttcgtcgtggctttaatcataatgcctccaaggcatgataaatcgtaaaatccggcatattctttcccgaaaccgaaacatccggaagcggggatgatcgggtttttcaattggagacccggcagattcacctctaacattacagcgccacctcctcagctttaaataccggcccgtcaaggcagacctttacataggatgtatcgctttcacccgtgcggcacacgcaggcgaagcaggccccgatgccgcagcccatccgctcttccatcgaaagataaacctctttatggccgtactgctgcttcagagctttcagcatcggtgtcggtccgcagcttagcaggacatcgaattcgagctgcttttcacggatgatatcggtgacaaatcctttctctccatatgttccgtcagccgtcgccacataagtgtctccgtacgcacggcattcctgttcgtaaaaaacatcctttgctgattgaaatccaagcacatgaatgacgtttacgcctttttccgtcaggcgctttgacagttcctgcaaaggcggaacccccactccgcctccgactaacagcgcggttttgccgggttcaatccgccgcacgggaaatccgttgccgagagggccgagaacgtctattttgccgccctcttttttcccggacaaaaggcgcgttccctcaccgtcagctctgtagataacggatacttcatccgcggcgaaattgacgtccgcaatgctgagcggtcttcttaatagcggtgtgaccgcgtcactcaccttcagatgaagaaattgtcccggctcggtaaggtgccggacaagctctcctttcagcaccatcttataaatccggtcggcaatttctaagttggattgaacagtcaaatgcgcttttttcatatcgtgactgccgccttttgattggtttcggatgcaggcatatgatccgcccggaatgtcatgctttccaatacccgcaaaatggcttcggccgtatctaaagatgtcaggcaggcgactccgttctcaacggattcgcggcggattctgaagccgtctctggccggctgtttgccctttgtcagcgtattgatgacaaattgcgcttctccgtttctgatcacatcgagcagatttttcccttcttcgccgattttcccgacgacttgagccggaatctgagcgtctttcaaataagccgccgttccttccgtcgccaagattttatagccgatggcgtggaaccgcttggcgatcagcagtccttcttctttatctttatcagcaacggtcaacagcactgaaccgtagttcgggatttgaatgcctgaggcaatcagcgctttatagagcgctttttccaaggttgaatctttgcccatgacctctcccgtcgacttcatttcagggcctaacgtgatatccactcttctcagcttcgcgaatgagaagacaggcgctttcacgaacaccccctgctgttcaggctgcagcccctcttgatagccgaaatcagcaagcttttggccgagaatgacctttgtcgccagattcgccatcggaatcttagtgattttgcttaagaacggcacggttctgcttgaccgcggatttacctcaagcacatacacctcaccttgcgaaagtacgaactggatgttcagcaacccgatgatgttaaggccttttgccaaggcaacagtgtattgttcgatttttttcttaatgtctccgcttaaagactgaggcggatagacggcgattgaatcccctgaatggacgccggcccgctcgatatgctccataatccccggaataacgactgtttcgccgtcagatacggcatcgacttcgatttctttccccgtcagataacggtcgattaacaccggatgctgcgggttgattttgaccgcatttttcatatagtgaagcagttcttcttcgtgatagacgatttccatcgcccggccgccgagcacatacgaagggcggacaagtaccggatagccgatggatgcagcgattttgaccgcttcgttcaccgacacggcggtttttccgagcggctgcggcacattcagcgcctcaagcgcctgctcgaacttatcccggtcttccgcacggtctaaatcttcaagtgatgtaccgagaattttgacgccgcgggcgctcaattcttccgcaaggttgatcgccgtctggccgccgaattggacaacaacgccttccggctgttccaaatcaatgatgtgcatgacatcttctaccgtcagcggttcaaaatacagtttgtctgatatgctgaaatcagtggacaccgtctcagggttgttgttgataataatcgcttcatatcctgcctgcttaatcgcccagacagagtgaacggtcgcatagtcaaattcgacgccctgtccgatgcggatcgggccggagccgaggacgacgacgctttttcttgatgttacctcagactcgttttcttcctcatatgtgctgtagaagtacggggtttctgattcgaattccgccgcgcatgtatccaccattttatatacaggcttgatggctgcttcttttcgcatttgatacagctcttgttccggcatattccattcccggctgatatatttgtcggagaaaccgagttccttcgctgtctgcaggacggcgaggctgcctttttccgctttcagctcggtttcaaaagcgaccagcttacagagcttgtgcaaaaagaatacgtcaattgcggaaaactcatgaagctgctccactgtgtagcctcttctgaacgcttctgcaagataaaacagccgttcatctccggcctttctgatccgtttttccaaaagcccgtcagaaatctcttccgcatccttcagttccaggtgatagacatcggcttccagtgagcggaccgcctttaacagcgattcttcaagggtgcgtccgatggccatgacctctccggtggctttcatctgcgtcccgagcctgcggtttgccgactcaaatttgtcgaacggccagcgcgggattttagaaacgacatagtcaagcgcgggctcaaaagccgcatatgtttttcccgttacgggattcatcatttcatcaagagaaagcccgactgcgattttcgccgcaagctttgcgatcgggtaacccgtcgcttttgaagcgagggcagatgagcggctcactcgcggattcacttcgataatgtaatattggaagctgtcgggatcgagcgcgagctgaacattacagccgccttcaatgccgagcgcgcggatcagctttaatgaaacattgcgcaaaagctgatattcccggtcgctcaaagtctggctcggggcaacgacgatgctgtcgcccgtatggatgccgaccggatcgatattttccatgttgcagacgacgatcgcgtgatctctgctgtctctcatgacttcatattcgatctctttgtaaccggcgatgcttttttccagaaggcactgatgaacggggctgagctttaatccgttttcgacgatctctttcagttccgcttcattcgagcagatgccgccgcccgttccgcctaatgtgtaagcggggcgcacgataaccggaaacccgatccggccgacaaattcctcggcttcctgtaaagtgcggatgatctcactttccggcaccggttcattcagctcattcatcagcgtacggaataagtcgcggtcttcagcctgctggatggcggacagctttgtgccgagcacttccactccgcattcctcaagaaccccgagttcagacagctcgacggcaagattcagtccggtctgtcctcccagagtcggcaggatggcgtccggccgttcttttctgataatacgcgtgagaaactccggcgtcagcggttctatgtatacccgatcagccatttccgtatccgtcataatcgttgccggattcgagttgacgagaatgacttcatagccttcttcctttaaagcgagacacgcctgtgtgcccgcataatcaaattccgccgcctgtccgataataatcgggcctgatccgatcactaaaatctttttaatatctacgcgttttggcataccgcttccccttctttctcagttgtttcgatcaagtcaatgaatctgtcaaataagtgattggcgtcttccggtcccggtgaagcttcagggtggtactgaaccgtaaatgccggcaatgttttatgcttgagtccttcgatcgtttgatcattgatcgcaatgtgcgtcacttcaagctctgtctcatctattgaagaaactgtatatccatggttttgggctgttaaagcgactttccctgtcgcaagctctttaaccggatgattggaacccctgtgtccgaatttcattttttccgtttccgctcccgatgccagcgcaaataattgatggccgagacagattccgaataacggcaccttcccgagtatgccttttatcatttcaatggcttccggcacatctttcggatctccgggtccgttagaaagcatgatgccgtccggcttgagctgaagcacttcttccgccgttacattgtacggtacaacgatgacatcgcattttcttttgtttaactctcttaagatgccgtgcttcataccgaaatcgacgagcacgatgcgtttgccgcggcccggactcggatatgccgttttcgccgatacttgagcgacttgatttctcggcagttccgtttctttcagccttgcaagaacctctccgacattctcctcacttgaagcaaacgttccttttaatgccccggccgtgcggatcattctggtgagttttcgcgtgtcgatcccttgtaagccggggatttttttcattttcagatactcatcaagcgtgtaagctgagcgccagttggaaggcagctcgcacagttcttttacgatcagcccttttacaaaaggagtgatagattcaaagtcatctctgttaattccgtagttgccgatcagcggatacgtcagcgtcacgatctgcccgcagtaagaagggtctgataaaatttcctgataaccggtcattcccgtgttgaatacgacttcacccgcggtatgctccaggctcccgaatgcttcaccctcaaataccgctccattttccagcactagtcttcttttcatttgacgagtctcccttcttcatatgcaagcttaccggcagccatcgttgcaacaggccagccgaagcacttcatcttgttgaatggcgtattttttcctttagataaaaatgtatctttgtcaatggccgcttctttgtccagatcaattagggtgatgtcagccggcgcccccggtgcaagcgttccgtacggaagaccgaatgcctcgcaaggttttaccgtcatgaaatcaaccagctgcttcagcgtccacgtcccgtttttcacaaaatgtgtgtacagaaggggaaaggcagtttctaacccgacaataccgaaaggcgcaagcttcatgtccgtgtttttctcttcttctgtatgcggcgcatggtcagtggcgatgaaatcaatcgtgccgtctaaaagcccttcaatcagcgcctctctgtcctctttgctgcgaagcggcggattcatcttaaaattggtatcaagtcccgggatatcttcgtcacaaagcagcaggtggtgcggcgatacttccgccgtcacgcggatgcccgctttttttgcgtctcttacggctctgacggattctttcgtgctgatatgacacacgtggtaatggcagcccgccgcttccgccagcagcacgtcacgggcgatatgtaccgcttcacaaatggaaggtatacccttcaggccgttcgcttttgaaaaagaaccttcatgcacgctccctccgtaaataagtgagttatcctcacaatgagcgacaatcgctttatttattgaagccgcccgtttcatggcttcatacatcattccggccgtctgaactccgacgccgtcatcggtgaaggcgaatgcgcccgcttcatgaagcgcctcaaaatctgtcatctcttcgccggtttgtctgatcgtaatcgatgcgtaaggaaggaccctgacagatgaggtttctttgatcctgttttgcagccattccatctgctctttcgtatccggcaccggccttgtattcggcatggcggcgactgtggtaaaaccgccccgcgccgcggctttagagcccgtctcaatggtttcttttttctcgccgcccggttctctgaagtggacatgaaggtctacgagcccaggtgaaacgaacagtccctcagcgtcgatcaccgtttctccgtctttcgctgtcagaagcccggtttccgaaatgaattcacccgttacccggatatcatgtaccgctttttctccctgttcatttaatatccagccgtttttaatgagataagacataagccgcttctccccttttcacattggtttgcagtgctctttttaagactgccattctgatatacacaccattttccatttgtttaaagattcttgattttccgcattccactaatgttgtgtcaatttcgactcctctgttcaccggtgcgggatgcatgatgatagcatgccgcttcatgctctgcgcccgcttttcggtcagcccgtatgcttccaggtagcctttttggtcggcttctgtctgatgcctttcattttggatgcggagcagcatgacgacatctgaagcttgtatggcctcatccgtctgaacacaggtgccgaaggcgtttttctcatcctgccactgcggcggcccggaaaacagcacacgtgcgccgagccttgtcagcacctcggcatttgaccttgccactctgctgtgtttgatatcgccatgaatggaaaccgtcaggccctgaaaggtctcaaattcctcttgaatcgtcattaaatcaagcaatgactgggtcgggtgctgtccgcagccgtctcctgcgtttaagaccggaatattgactctgccggtcagatctttgtaatattcatccgtgctgtgcctgatgacgcaggcgtccgctccgattgattccagtgttttgaccgtgtcgtataaggactcgcctttttgaacgcttgtgctcgtgccgtctaagctgagcacgttcatcccgagtttcttttccgccacttcaaagctgaaccgcgttctcgtgctcggttcaaaaaacagattcgcaacgaattttcccgcgagatcgggacggactgcaccctcttttatcgcttttgcctctcgcagcagttctgtaatttcagccgcgctcagttcagacatcgccgttaaatgattcatgttttttctcctccgtttccgcttgaaggccgtaaaaaacaccccggtctatagactcggggtgcggttaaagagagaagagccgtacagcgtcttcccgttataacccttccaagcctctctggactttctttaaaaggtttacatatgatttagtttttccgatgcaatcgcgtcttcttcatttgcatgcggcaggataaggttcaggatgactccgacgattgccgcaagcgccatgccggatatttggaacccgccttttgatacttgaataaaagcccctccgacgccgatcacgaggatgacggatgtgataattaaatttcgcttgttttcataatcaatgttgttgtcaatcagcattctcaagccgctggaggcaatgattccgaagagcaggaaggaaacgcctcccataaccgcggacggaacagagctgatcagcgctgaaactttgccgataaatccgaagcacagcgcaatcactcctgcgccgccgatgacaaagacgctgaaaactctcgtaattgccaggacaccgatgttttcgccgtatgttgtcgtcggcgggccgccgattaacgaagcgataatcgtcgctacgctgtcccccattatggagcggtgcagtcccggctttttaataaaatcctgtccgacgactttactcagcaccatttggtggccgatatgttctgacatcgtcacgaaagcgaccggcaccatcgcagcggcaatgcccaatgtcactgacggcgtgtagtctttgaaagggatgataaattcaggaacggcgaaccattttgcatcaatgaccggctgaaaattgacgatgccctgtgtcagcgcaaacagatatccgcctataatgccgatcaataccggaatcaagcttaaaaatcctcgtaaaaagatggcgcagataatggtgatggccaaagtgacgccggctacactgaaatgtttcaggctgtaaacgagttccttcgcattcggatcagcatacattgccatattgacggctgtgcttgccagtccgaggccgatgacgatgatgaccggcccgacgaccaccgggggcagcagcttcatcagccaccccgttccaagctgcctgatgagaagcgcgatcaggccgtacacaattcccgccaggaaagcgccgaccatggcagcccccggccctcccgtcgccttcaccaagataatcggtgatataaaggcgaatgatgagccgagataagcgggaatctggccttttgtcaccaagagataggcgagtgtcccgattccgctcgtgacaagcgccactgccgggctcattccgaccagtttcggcacgagtatggttgaaccgaacatggcgaataaatgctgcaggctgaatgacagccaggacaatggattggggacgtccctgactcccaggtttacttttttcttactcatggcgttttcctcccggttgactttcaaatggtataaaaaaacctctttgctttttgcgcaaagaggcatacaaagcccggccgtgtcgatccgcccggctttgtgttttaaaatcctctttgcaaactctctggaatgcatttaaaaagggtggttattcattttcgtaaatggcgaccatatcagtctgatcaacttcgctcagctgaaccatcactttttcagcttttgaggtcggaatgtttttcccgatatagtccgctctgatcggcagctcccggtgtcctctgtcgacaagcacggcaagctgtatcgatgacggccgcccgacatcaacgagagcatccatcgcagctctcaccgtccggccggtataaagcacatcatcaaccacaatgaccttttggtctgtgatatcggccggaatgtccgcgccttttacaagcggctcttcattgctcgttttttttgtgagatcgtcacggtaaagggtgatatcgatttccccgacggtgaccggatttccttcaatctgttcgatccgctcggccagccgcttcgctaaataaatacctcttgttttaatccctacaagaatgcagtcattcattcctttattccgttcgatcatttcatgggctatccttgtcagcgcccttctgatggcctgttcgtcgagaataacagctttttgattcaatcgtgacacctctccattcgtatataagaagaaaaaacccctcctgccagagcatagaggggttcctttccaggaccaagacacacgtgtatctcttctgtcctatccgttatccttctcagcctctctggactgtgttaaagaatctattcagcttgtttttattatttcagaaaagaaactcgctgtcaatggctatttctcaaatgttcaatgagttttttcatatcttcaggaaggggcgcttcaaactccatgtattcgcccgtccgcggatggtcaaaacctaatattccggcatgaagcgcctgaccgttgaaatcaatggtttttctcggtccgtacttcgggtcgcctgccaaaggaaatccgatatatttcatatgaacacggatctgatgcgttcttccggtttcaagacggcactctacgagcgtgaagtcttgaaaacgctcaagcacgtggaaatgcgtgacggcgtttttgctgctttctcttgttacggtcatgctttgtcggtcttttttatctctcccgatcggagcgtcaatcgttccgtcatcatgtgaaatcaacccgtggacaaccgctgtgtactttctcgtcacggttttattgacgagctgattaacgagtgattcatgcgccatatcgtttttggcgaccattaacaggccggaggtatctttatcaatccggtggacgattcccgggcgcatgacgccgttaatgcctgaaagatcgttgcagtgagccatcagtccgtttacgagcgtccctgtcacatggccgggcgccgggtgtacgaccatgccccgcggtttgttcacaaccaagacatcctggtcttcatagtaaatgtccaaatccatcggctctgcaagcacgtccaattcttccggttcaggaatggtgacgtttacctgatcgccgggctgcattttataattcgcttttacggatttgccgttaacggataccagtccctcttttacccattgctgcacttgagtgcgtgaccagttttctcccgttgaagccaaaaatttatcaatccgttcgctcttttgttcaggctgaacggttatctcaaattgattcatgttattgctccttctttttcccgctgtcaaacagcatatgaataaataaaagtattacaccgacgcacagtgaggagtccgcgatattaaaaatcggatagtgataatccacgatgatgacatgaataaaatccaccacttcctggcgcgccgcccggtcaataaagtttccggccgcacctcccagcattaagccgagagaaattccgagtaacatctgcccttttgcataacgctgtatgtaataaacgattccgataatcacggcgatggtaatgacgtagaaaaaccacatttggccggctaaaatcccccacgctgctcccgtgttgcgatgagatgtgatataaagcacctggtcgatgacaggtatgctttgtcccaattccatatggctgacgacaagccatttggtcaattggtcggcaataataataaaaagagcgataagataataaagcacacacgttcctccagtatacagttacttttatcctttatgaattttatcagtaaaagatgccggagtaaaggcagatcataagcgtatgcaaacagacgctgtcactcatacagcgcctgatcatatgcataatctccggttacccagtatggaagggttttcttttcaaattgagcgggataataaaaatcatcagcggttctggccgtcggcagcaccgcaagtttttcaatcggaatgggggcgcctgttttttcacaataaccgtacgtattgttttcaaacttagacagggcaagaagaacatcctgaagttcttcttttatatgatagatcagagttgcttcttggtcgttcattgaaggttcaacagatgctgacatttgaaagcaagaatattcgaataatcttgattgaagttcttctttcatcatgagaagctccgtgtggattgcggtcagttgatcattcattcatcacaactcctgctcttgatgttatagctttattgttgccctcagagcgctatttgaagcccataagaattttcctgccgttctaatcgatgacattgctggcatgtaaaaaagcgcccggctgacaccgggcgctttctcatttattatttttgataatatttttcaacgatttccgcattgcgcagtgataatgtcggatatttcggattggctccgacatctttagaaattacgcgggaacgctcacacatctggccttccgctttttctacggtcatttttcctgttgtaaagctttgcgcgttttccggcgcttcactttcgtcttttactgtcagttctgagacgataaacagctgcgcgatgttttctttaatggatgacaagaggtcgcggttttctttgttcggatacaaagtaaggctcgcttccaatgatcttccgataattttttcgttacgggctgtttccaaagctttcagcacgtcgtttcgaagctccatgaagcggtcgaatttttcttctgtcgcctgactgtccggaacagcaatggtttccggcatatctgtcagctgcacgctcgcttcttcaacaaatgataagtgagaccacatttcatccgccgtatgcgggagaatcggcgccgtcagtttcactaacgccagcagcgtttcataaaagacggtctgcatgctgcggcggtccggatgatccgcatgctcgatgtacacaacatcttttgcaaaatcaagatagaaggagctgagctcgatcgtacagaaattgtgaatgctgtgataaacaaccgcaaattcgtattcatcgtacgcttttttcaccttatcgatcagcttattcagcttgatcagcatatattgatccacttcgcggagatcttttacatccacggcattgatgcttggatcaaaatcgaacaggttgccgtgaaggaagcggaacgtgttgcggactttccggtatacttccgcgacctgcttcagaatatcttcagaaaccgggtgatcggcctgatagtttacggaagatacccataaacgcagaatttcagctccaagctgttttgcgatttttgtcgggtcaatcgtattgccgagtgatttactcattttacggccgtttgcatcaagtgtaaatccgtggcttaatacgcctttatacggcgctttgccggtgactgcaacagcggtggaaagagatgagttaaaccagccgcggtattggtcagagccttcaaggtataaatcagccggacggacaagatcatctcgttcttcaagaacggcctgatgggaagaacctgaatcaaaccatacatccataatgtcttgctctttcgtgaagattccgttcgggcttcccggatgtgtaaatccttccggcaggaggtcttttgcctctctttcaaaccatacgtttgagccgtgctgtttgaacagctcagacacgtgttcaatcgtttcgtcagtgatgatcggctcaccgttttctgcataaaataccgggatcggaacaccccagacgcgctgtcttgagatacaccagtcaccgcggtcgcgcaccatgttgtaaaggcgctgttcgccccactccggcacccacttcgtttgtttgatggcatcaagcagatcggatctgaaatctttaattgacgcaaaccattgcgcagtcgctctgaagatcgtcggttttttcgttctccagtcatgcggataggagtgtgtaataaactcgagtttcaaaagcgcgccgttttcttcaagcttctccgtgatcggtttattggctttatcgtaaaacattccttcaaagcccggcgcttcgtcggtcatgtttcctttttcatcaacagggcacagtacttctaagccgtacttttggccgacgataaagtcatcttccccgtggcccggggcagtatgaacacagcctgttccggcatcggttgtgacgtggtcaccgagcatgacgagtgaatctctgccgtacagcggatgttctgcagtgatgtattctaattctctgcctttatatgatgcgacaacttcaggattttcaaagccgcatgcctccgctacgttttcgatcagttcagccgccactacataacgcttgtctccaaccttgatgacattgtattcaagatcaggatgaacggaaattccgaggttggcaggcatcgtccacggcgtcgtcgtccagatgatgaagctttctccgttttccagaacgcctttaccgtctttcactttaaacgcaacataaatagacgcggaacgtttgtcctgatattcaatttccgcttctgctaaggcagattcacttgaaggcgaccagttgaccggcttcagacctttataaatatagcctcttttcgccatctcgccgaaaacgcggatctgctgcgcttcaaattcaggctgaagcgtaacatacgggttttcccaatcgcctctgacgccgagacgcttgaattgttcgcgctgtctttcgatctgctgccatgcataatcttcgcaaagcttgcggaaatcagcgacggacatttctttccggtttacttttttgtttttcgtcagcgccgtttcaatcggcagtccgtgcgtatcccagcccggcacgtacggtgcgttgtagccgctcattgatttatagcggacgatgaagtctttcaggattttgttcagggcatggcccatgtggatgtctccgtttgcataaggaggtccgtcatgcagcacgaatttcgggcggtctttcgtccgttcttgaacaagacggtaaatgtcctgctcctcccagtctttttgcatgtccggctcacgattcggcagatttccccgcatcggaaaatctgttttcggcattaacagcgtatctttgtaatccattttcattcctccacaacatttttcagaaaataaaaaaagccctctcatcccataagggacgagaaagcttatctcgcggtaccacccttttagaaaaaacggatcatccgtcttttcctctcgaacatcgtaacgtgatggaacgtcctttcctactctcggttcagaaaggaaactaaagggctgatctgcatgattccggccatcccgggctttcaccttccccggttcgctttatagcctgttttgagtcatgccggtccctttcaatcgtcttttcatctgaatttatgaacgtattatattcgaacgggccgaagaatgtcaagaaaatcagaaaattattctttttcctcaaataccgcgtcgacttcgtattccagcagatgatcccaatcatcgttcttcagcaggtcgagctgcgcttcaatcagcatttggaaacgtgttctgaagactttagactgttttttcagctcttcgatttccattgcgatttttcttgatttggaaagcgactcattgatgatgcgatcggcatttttttctgcttcacggacgatcagcttcgcttctttctgcgagttgcgctttacgtcttctgcggcttcctgggctacgagaattgatttattcagcgtttcttcgatattggcaaagtggccgattttttcgtccagctcgttcactttcgcctcaagctccgtttttttacggagtgcgatttcgtaatcttttctgacctgcattaaaaattcatttacttcatcttcatcatatccgcgaaaaccttttgtaaacgttttgttatggatatcattcggcgttaatggcatattgccacctccatttttacatttcagtacggttatctagttcacattataaaacaaatacggcacagatggagaaaaaaactgaaaaaacgactcatttttgccgttcaaatgtaactttccatttgtcttttttcgtttttccgtcaacttttgccaaactgcatcgtccgaagccgcgaatcgagagcatgtccccttcagcaacctgataagacggatcttcaatagctttccaattcaccttaacgagcccgtttttcacaagcgcctgcgctttctgccgggattgcctgctcattgaagcgcagacggcgtcgagacgcaatgaagaaaccgtgtcatcccttatttcgacatctgaagcgggaatgtgaagagcggaaagctcgattttctcaagctttaccggcgctttgcccgccttggtcagctgagtgctgacaaaatcggcgatttcaccggagacgatgagctgcacggcttcctctgagaaaatcagatcgccgtatttctgccgctttaagccgatccccattaatgatccgagaagagagcggtggtcaatgctgacgaatttttcagcgtattgaacgtcaaaagcccggagctcaaaatcatcctgttcaggttccatatattcagggtataaaatcgcgcgtttgcgctcagctctgtcatatcctccgaaaaacgcaagaccgcaggcgtcgccgataacggcttttacaatcacctgttccctgggatctaagaaatcagtcagcttcatccgatactggtccaggacaatctgtttccattcaagcacctgatcaataaaaggccgctcgtcttgtctgaagtgctggtaaatatcgctcatgttctttcctttctatgtaaagaggcttggctggtgccaagcccgtatcaaactgtcgcattcaagtatacattgcgatcatgcggtataggccccaaagtcccgtcgtggcaaaccgaagcacgataatcgctacaatcggggatatatccagcatggcaatgggcggaatgatccttctgaacggctctaaatacggttcgcaaatcgctgcgagaaaccgtccgaccgccgtttctctcgtactcggcacccatgacataaagatatagatgatcagggcaaacgagtagatgtaaattaaataactcagaacggaaaaaatttgataaagaatcatcctgctttaccacctctgatgttcgtcttcatttataagctccgaaatcgtgccggaaacgtcgacattatcaggcgtgcacagaaaaatatctgaaccgattctctgaatgtcgccgccgatggcgtagacggtaccgcttaaaaagtcgacgattcttttcgcctgatcatgctggatgcgctgcagattgacgacaaccgcccgcctgttctttaaatgatcggcgatttcctgcgcttccgcatatacacgcggttcactcaagaccactttagaggatttctgaacactttgcaagcttactacgttctgcttgccctgcggcttctgagcgtaagcaggctgtttatctttctgctgttcatgctcttcctgatgatcctgctccgtttcaatgtattcgtactcgtactcctcctcatccattgagaaaaagtttttcagtttatttttcatgctcatttgtttacaccccccggttcatttccgactaatgaagagccgattctgataaaagttgcgccctcttcaacagcgatttcataatcatttgacatgcccattgacagttcccggcacggcgcgtttgtctgattcagtttttgcacctgatccctcagatcacgcaattgccggaagcaggctctgatcgtttctgtatcgtctgtcaggggagccatcgtcatcaggccctctacagaaatgtttctaaactcagaaagctctctgataaaggggatgacctcctctgttttcaaaccgtgcttagacggctcaagcgaagtattcacctgcacaaaacagcgaaccgtatgctgcgcccgtttttcaatctcttttgccaatgacagtctgtctaaggaatgaatataagatacacggtcaacgacggccttcacctttctggactgaagactgccgataaagtgccacttcgggcttcctttgatgacttcctgcttatggataagctcggcatcccggttttctcccagacttgtaataccggcatcaacggcctcttgagccctttcagctgatacgtattttgtaaccgcgatgacggtaacatcttcggggcttcggcccgatctgttacatgcttcgtttattctttcgtttatatgtcgtaattgatcagcaacacgcaagatctaatgcctccttcattccgataaaggacatcatgcgtcccgttttccctttgtcgcggcggtgtgaaaagaatagttcatgctctcgttcggtgcataatccgctgactgaaatgttttcttccggaatgccgcaatgtatcagaagaagacggttgacctcttttaaatcaagctgatactggcctttttccgtttcgcatatggcggattcagccgtaaagggcagcgcccgcacttcattgatgacgcggtcgtcgactgtatagcttcccgcgctgatggacgaaccgatgacagcctgaatatctgttaaacgggagccttcttcgtttacccagcgttccgtcatgatgcgtccgatttgtttgaccgtccccttccatccggcatgggcagcgccgataatggatttcaccgggtcataaaaatacaagggcacacagtccgcaaaacaaagggccaaaaaaagattcgcatctttcgtgtagagcccgtccgtcccgcggaatgcggaagaatagtctctcgctccttttcctttatccccggctgtcacgcgccggacgcggttttcatgtgtctggtcggcgaacacccaggaatccagatcagtaccgcataaggacgctatgacttcacggtttgtcacaacatcatgagcttcgtcccggacgtgcaacccggtatttaatgactcatacggaggattgctgacaccgccgtttttcgttgtgaatccggcgatgacctttgtgttaagctgattcacacagttccagtcttctatcatgagtgccgaggggtggtaagactaaacgggtgatatgtattcatggagatccaacctttcgacaaacattaaaaaagcgtaatttcccactcattttaacacaattttaagcatacgtttagcggctgattgaaaaatgagataaataaatgtgccggaaacattgagatttccggctttttacaagtaaagggaggattacgctccccctttggttcatttacacgcactaagatgacatcttccccaattttaactatatttcgccaaggaatgatcatttcctcttcttttccgaaaaaaccgagaacttttccgctgccgcctaaaataatcgcctgaatttttcccgttgtcacgttaatatcaatatccccgatgcttccgagtttttttccgttcgacacgtttaccacatcttttatttgaaattcagatatgctgatcatccgtatcacgccctttgcccgttctttttcctattatatgaacggccgggctgaaccttgtcacatcgggcaatcttttttgcggctgcaccagccgagaataaatctcagcatgattttcgtatagtccataagctcatcaacggacacttcctcgtttacggagtgggcgttttttaaatcgccggggccgtatatgacgctcggaatcccggcctgataaagccatcctccgtctgttacggtttgggaaacatcaatgacgggctcctgttttatgacggcagagtgtgatgcagccaagacagaaactgccggatgatccggatcgatttccagcgccgggaacacctctcctctgtcttcaatcatcgaagatccgccccatttgaacaccggcctgttttctttgagccacagatcactgtcagcgacacgattaatatagtcttcgatttctgcggctgcttgttcgtgcgtttcgttcggataaaagtggacggtgatccataaccggcattcatcggcgacaaacgctgcgtgtcttccgccttcaatgacggcggggttgatcgtattggtgccgggcgcaatgccgggatagcttttcgttaccgcccagtggcgctccagctctcccaaggcagtgatgattttcgccattttttcgatggcgctcgctccgaatgtgcctccgcccgcatgaatcatattgcgcctcatgccgtcatgaaatgtttgtttgcttttcaattctatccagccggtgatgacaccgccctgcccttgaatatgcaggctgctcgtatccgcgacaaccgcaaaatccgcgtgatagccgcgtttgcagcattccagcgtccccgcctcgccgacttcttctccgattacagactgtacaatgaggtcgcccggaagcttaattgcggcatcatggatcagcttcagagagaaaagaacacacgccaacccccctttcatatcagcggcgccccttccgatcagcatgccgtcttttacgagcggctgaaacgggtcagagttccaatcttcgcccccggcttctgccacatcaatgtgtccgtttaaaatcaggctttgatgcctgcttgaatctgtcccttttaaaacaccgactacattcggatcttccggatacacatcccacatatcgaccgagcagcccgtttcttttaaaaagccggccacccacttttgggcttctgccgtatttcttgctggcggggccggagtgggaaaggcgatcaacctttcagcaatatgtatgaagtcgtgcctccgtttctccgcctgttgtaacagcatatcaatctgatgcattggaaatctcccctttagctgtatcaaaaaacccgtttcattaaaatgaaacgggtaaaaaacggatcttcctccgcttttttcaccgcttccctccgccggcatgatccggatcaggtccgttaagggttgagacaacgtctctctcagccgcatggcagcacccccagggtgaattgatgttattttacggttgatgcctcttttgcacgtgttaaaaacgggcggccattgttccataagacattgacaggcgtatcgaaaaacgctgtaagccgctcgtcagaaagcatatccctgattttcccggaggcgaacacctcgccttgttttaaaagcagcgccttatcaaataccggcagaatttcttcagcgtgatgggtgacataaaggatggacggcgcattttctttttcggcgatcgacgtaatcgtgtccagcagctgctcccttgccataaaatcaagacccgtcacgggctcgtccaaaatcagcagtttgggatcagccataagcgcccgcgcaatcagcgctctttgtctttccccttgtgataatgtttcataccgcctgtcggcgtaactgatggcgcccaaatccttcagaagaccgatcgctttttcccttacctgctcactcggagtttcgtacagcccgattgaggcgtacgcgccgctgagggcgatttcaaaagcggagtccgcggcatataatttgtgctgaagacctgccgaaacaaggccgattttccttctgagcctgtcaccgagctctgttttgccgaactgatggccgagcacctgcatctctcctgaagtggggaagtaataagagcataacatattcagcaaagccgtttttccggctccgtttaatccgtacagcacccaattttcgtttttctcgacgcgccagttaatatctttcaaaatccatttcccgtttctttttaatgacacactgtccagctgtaaaatcattgccgtttcccccgtttactttatttaaattttctaaaaacttttacacattagaatacatcacttttttgcaaacgtaaaccatcgcatgaaaaaagcctttaaacaaggtttaaaggctttttccgttattgatggatattcttattcatttgtttaatggctgccttttcaagccttgagacctgagcttgggatatcccgatttcttcagcgacctccatttgggttttcccttggaaaaagcgctttcgcaaaatcattttttcccgttcgttcagtcttctcatgccttctttcagagccagctcctcaatccattgtgtatccttgttgcgctcatcgctgatctggtccatcacgtagatcggatcgccgccgtcattataaatcggctcaaacagtgaaaccggatcctggatggcgtcaagggcaaacacaatttcttcatggggcacttcaagaactttggcgatttcctctgctgtcggctccctgcttgtctcactgattaaccgctctcttacttgaagcgctttatatgcgatatcgcgaagcgacctcgagacgcggatcggattgttatcccgcaaatatctgcggatttctccgatgatcatcggtacagcgtatgttgaaaacttaacattatggcttaggtcaaaattatcaatggatttcattagtccgatgcagccgacctgaaataagtcatcaacatactctcctctgttgttaaacctctgaatgacgcttaagacaaggcgcagattgccgtttacaagcttttccctcgctgaatcatcgccctcatcctgcaattgcctaaacagctttctcatctcttcattcttgagcaccggtaatttggaggtatccaccccgcaaatttcgactttatttcttgacacgtttttccctcccactaggagctgctgtacaacgttaagtatctcctcgggtgggaaaaatatgcaccgctattttacagaaataaacatccggcggcggcaatccttgcagcagtaagggctgtcagatggaaaaaattttacaccattttgttaaactcttttctcagtcttttgataatccgcttttcgagccgggagatataagattgtgaaatccccatcatgtcggctacatctttttgggttttttcttcttctccgacaagcccgaaacgcagttccataatctgcttttctctttcgtttaattgctcaagcgcttttttcaaaagttttttatccacattggcttcaatgtctttcgtaataatatcatcatctgtgccgagcacatccgaaagcagcagttcgtttccgtcccaatcaatgttcagcggttcatcaaaggacacctctgaacggattttattgtttcggcgcaagtacattaaaatttcgttttcaatacatcgcgatgcgtaggtggcgagtttgattttcttttccggattaaacgtgtttaccgctttgatcaaaccgatggtgccgatgctgattaagtcctcgatattgatgccggtgttttcgaatttgcgggcaatgtaaacgacaagacgtaagtttctctcaatcaggatggcccgcgccgcctgatccccgctcggcagctttaataagagcacctgctcctcttctttagacaaaggcggcggcagcgcctcgcttcctcctatgtaatacacttcatcgcttttcagtccgagtttcatcagccatttataccacaaatatgtcagacgcagcttaagttttttcatcttcctcccccttctaaataccacgcgttttgagtatgatgaataacagacttttcgtcaggaaacatgttttacagccttccctgtcagcatcttcggatgaacgattccgtcaaattcaccgtcagcggataatggcttcgtgctgatgccgatcaggcatttttcacatgcgatcatctcgtcttttgttaaaatcgtgacgtaatccggctttaaacagagtaaaaattgattgtcctggccgacgcccctgtatggaatcagcctcagcttatccgcatggcggaacgaatcatcaagctgctctatcacttcaagcggactggcggatttgatgaagtccgtttccttttcgctgaggatcggagcgaatttgttaatgtgaaggatcatgaccggcgttttcgtcagcggatcatacagctgattcccggaatccaccaatcctttcgcgcggattgtctgtccgctgaattccgcctgcaccatgacaagttcatcgtactgaatggacttcgtctcgatgtcttcaattctctttttcgaaaaaaaccatatggccggaaatccgataactacaaacatccagctgatcgggtcgccgaatccggtctggcttgtaaccattacgccttgctgcacaattgattctgtctgcagcagggaatgtacgccgatcattcccccgccgacgagaaaagtcgcgaaataaaaggcgaacaaattttgaaaaaagtatcggaaccgtttaaagccaaaagccgtaagcacgatgactaccgaaaacgccatttttcccgccggatgctccacaaagggagaaataggcgtaaacatcagaagcacaatggctgacccgatgaaaccgccggcggccactcttctttttttcacctggcgttttaaaataaaggcggtcaataaaagcaaaagagaatcaaaacaaaagttcaacagccaaatgacatccagatagattttcacatctgacccctttcctcttttgtcttacatatctgtttctctctcttgtttcataagtataaagcaagctctgtgggaaagtctgtcaattaatgttgagggtaaagtacaatttttaagggataaccgttttatttgtcgagggccgaaaaggttgattttctattgtccccttcaactaaaaaagcgctgccgtgatttggcagcgctctgtttttactcattgatataaagttttcctttagccgtctgtctcgtttcatttccgtagtcatctcttgcgataacgtcaatttttgctccgcttgctttgatggaagaagccgccgtccagtaaccctcatatcgtcccggagaaatttctctcagcggaagctctgttgcgttttggctccctgcccgggcgtttgtcagaggcagacggatcacgaaggaagcgtctaatttctttccgcttgaaaaagcgattttcactgattctccggcttttaattccttatccgctccgggaaccaatccggaaatgacgggagcattgtaattgacatcgattaccgtctttttcgttgttttgttaccagcttcatctgaggccgtgaccttgatctcattgctgccgttttccagaagggttctcgcttgataagaaccgttatttacttcagctttttttccgttcacctttacccattttaaatgggcgtcgtgcacttttccttttacagtcactgcttctttatttgttttatcaccgtttgccggactgtcaatcgtcacatcaggcttatcctcatccagtatgaccgtgacagggcgtgactcgtcggttgacccgctgtctgtcacagatgccgctgtcagccgattgccatctttagtgagtgtgacaccggcctggaaactgccgtctgcatctgctttcgtttctgcggcggttttaccgttattggtaagacggacagcggtttttggtgaagccgttcctttcaccgtgattgacttcttgtttgtaaatgaccggttttcaggcgacgttatctcaggcacagaagcttcgtagtcgaccaaagccctgatcataaagtttccgtctgttttatcggcttttgaccagcggccgtcgaggtattgccagtttctgttcgagtacgggctgccgtcatcagatgacagggcaggtgtataaggatcgggtttcgtctgacggaacacaagataaaaatcctttccgaccgcgattccttttgagctgagatccactttggtccactcgccgtttcgaagcgcttcagcttggaacgggccggcaattttgctgcccggagctccatcagggccggatgcatcatatacttctgcttgaaattcggtaccgcccggatcaggccagtcggcgccccaaaatttaaaaaggcctcccgtcagcataccgtgttcttttccgtctttgagggtcatcttaacggcagatttgctgccggctttaaaatatgacagcgcggcttcttccgtcccgttatcataggcgatttccccttcataaccgacatacggcttaagcttgacgtttttttcagcatctcctttgatgtcgacagaaaattcgctattgtaaaagccttttgccgctactttgattgtgtaggagccttcatacgccttaagcgaatattcccctttatcgtttgtcaccgccggctcaattgcggcatcctcggccacataaagcgcagccccttttaccggttcgcctgtggactgattggtgatggttccttttagcgtgccggacggcatttgctccagtgtaaagtctgcctgtgcggttttgtctgattgaatagaaacttgtttcgaagcggacttaaatccgtaagcctcggctttcagcgtatagcttcccgccttatgtgacaggctgtaacttccgcttgcagggtcggaatatacggatttccccgtctcggcgacactgatttgcgctctgagcggcaggaggtttgtttcacgtttcactctttttccgggtgatttcactgccggtttggcctgtttcggactgatggcttttttcttcaggtggccgggaggtgtttgtctattgtgtttactttttttagccgccttgccgagagggctgcttgaaagccggatatcatcgatataccatccgtcttcattgagtacttcgtcagactgcatattaaacatgagctttatgttttggcctttatacgcagataaatccgcctcttcatcattccatcctgcggaatcaccattgtaaacggccgcctgctcccaatttgatttcccttccggcagaacgaacacatacccgtaatcaaaaaattcttcgagcttgtgccagcttttaaattgtaaaaacagccgccctgtttccggaacttgaatcggaggcatcacgagattcatgttggccgaatcggcataagggccggacagattcgtcgcatacactttatctccggaaaatgcggcgccgggccctgaacccgggataccccattcccattgatcatgtgtcccgtaactggaccagcccgccggctgtgattcaaaatcctctttgtatcccgccgtaatgctcggtttcacgtcagcccggtacgtatcagattctacagaatgacctccgaaatcttttatggtccatttataacttatcttgcttcccgttatgtccggaatctccgcctggtatgttccctttttttcatcaccgcttttttgaacggcggctgtcgttttccactctccttcatcaaactgataggagaggatcacctcagttatgcttacatcatcttctgctgtaaccgttaacggaaggtttgcccctttgtaagcctctgagaccggttcatgatgaaagctgggcggattgtgatcttcacccgcagaagataccttgccttctacgcttccgattccgtccgttacggcagaaacggcatcaaaagcgttaacgaggccgtggccgtaaccgttattcggtgattccggaaaaacggaatctgtcagcttttcggcggtgcgcgtcagaacgtcttccatttcatcgaccgtaatagaggcgttcgcctgccttaacaaagccgccgtcgccgccacatgcggcccggccattgaagttccgtcccagccgccttcgtatgttcctccaggaatagaagaacggatattcacgcccggagccgaaatgtccggttttgtttcatgatacggtgagggccttgaagtgagaaatcagcgagtttcttgtcgatgtcagtcgcacctgtcgcaaatgcttcaggataattggccggatttgcgattgaacccggtcctcccggtgtaaataagtcttcatttcccgcagagaattccggaaaaatccctgccgctctccacgcattcaccatatcgcggtaccactcgtccattcccgaaccgcccgcccaggaattattgacaacatccggcgccatctcgggatgcggcgtgccgtttttatctttaggcgcaagcacccattcaccggcatccaaaatatcggcatcggttcctccgtcatctgaaaatgcttttactgcgatccatttcgcccccggagccacaccgatttgatttgagccgtcaggttctgaacccgtcatggtccctgttacatgagtgccgtgttcaagatcgtcgtagggagcgtctttatgggacacggcatcataccagttcatttcatgattcggcgctgctggattttcaggatcgtaaccccggtatttttccttaagcgcgggatgatcccactgaactcccgtatcaatggaggcgacaaccgtgccggttccgtcgtatcctgaggcccaggcctgcggcgcatcaatttggctgatattccattcgatgccttcctttgctttgacctctttttgttttttcttcatttgaaaaggagcttttgattgccgttgagtaagctgacgtttttcattcggaagaactttttctacttcaggaaatgaggcggctttttccattacctctttcgaagcagtaactgccattccgttgacaatataataggaatggatgtgatcagcctttcctttctttttttgtttttccaaatatgttttcagattctgctgcgcatcatgagctgccagttttaaagaagaaacaacggctgaccgcttttgatattcggtttttgctgcggaaagcgaatgagactcggcatttttttctgcttctttgaccgcttttttcgtattggctttctctttaaatttgataagaaacgtgactttatcatttttttcaaaacgcttcttgactgaatcggaaatcttatgctgaatgctcttagaggaagaaagatctttggtaaaagaaactgcccccggtgtgctgttcgctccgactgcccccggaaacaacagtgaactgacgacaatcgcgcttaaaacggagcctgtccatctgtttctcgtttttttcttcaatcgtatccccccttatttggtaacgccctataaaatgtgtatccctccttcataattggaatcgtttgtcatttcgatgctgtacgttaaatgtagacaatcttccatccagatattgtcacattctgtagaaagccgtatgaaacttaaaaacaatcaattcgtcataggtataaagcttcttttttcactgtatagatcatgggggataggaaggaagactgtgcacaaaaaagaaaaaggacaaaaccatgtggtcttgtccttttttacatcagccgcgtttgttgcggtttcttaaaaatgtaggaatgtcgagggcatcatccgccggttgtgatgtatggcggttcaccgtgttttgatgctgtgtttcttctcgtttcggctcacgtttcgcagcattttggctttgagacttcaatccttggtttaaagtcggacgctgcggttttgagtcatctttttcctgttcgataaaaccggtcgcaataacggtgacgacgatttcatcttttagattttcattgataactgaaccgaaaatcatattgacatcagggtcagatgcagaagcgacgatgtcggctgcttcctgcacttcgtagaggctcaggtttgtacctcccgtaatgttcatcaaaacaccttgcgctccgtcgattgccgcttccagtaacggactggagatcgcctttttggcggcttcagcagcacggctttctcctgtagcgatcccgatacccatcaatgctgaacctttgttggacatgatggttttgacatcggcaaagtccaagttgattaaaccaggcgttgcgatgaggtcagagataccttgcaccccttggcgaagcacgttatcagcttcacggaatgcttcaagcatcggtgtgtttttatcgacaatttcaagaatgcggtcattcggaataacgatcagtgtgtcaacggcttctttcattgccgtgataccgcctgcagcctgcagctggcgttttcttccttcaaatgtaaacggtcttgttacgacaccgacagtcaaagcgcctaagtcctttgcgatttgcgcgatcaccggtgcggctcccgttccggtaccgcctcccattccggctgtaacgaacaccatgtcagcgccttttaacgcttcttcgatttgttccttactttcttcagcggcttttttgccgacttcgggattcgctcccgctccgagaccgcgggtcagcttttccccgatctgcattttcacttccgcttttgacaggttaagagcttgcgcgtccgtgtttaccgcaatgtactctacaccctgcacttcattttcaatcattcggttgaccgcgttattaccgccgcctcctactccgattactttaattgatgctaagccgtctatgtttgtttcgaaatccaacatgctaaatcctcctaatctgccgaatgactatcaatctattcccaaaacatgcttaatagttttttcattttgctcggtttgttgtgttcggcttgtgttttttgttttgcttttggacgctgctgcgcctctggccgctgatgatgttcttcttcgtgagagaccgcgatttcctgcacggcttcttccggcatatgaaagcctatttttcttccctgaattctggcatttcggcaggcaaattgtatcaagccgacacccgtcatatactgagggtctcttacaccgatataattcgggcttgcgacccttacattgtgcctcagcacttcctgtgccaatgaaagcactccgggcattgcggcctgtccgccggtcagcacaaagccgccgggcagatctgtaattcccatatgctcaatttcggctgcggcaatctcaagaatctcttccactcttgcttcaataatattggcaatttcctgctgtgtaaaagattgcttttgattcgttcctatgacggtgacttcaaatacttcatcttctgaagcctcatcgtagaatgcatgtccgaattgtttttttactctttcagcctcttcggtggaagtgcgcaatccgatcgatacatctttcgtgatgttttcgcctccgagcggaatgacggctgtctccttcaggtgccctgttcaaataccgccaccgtcgtcgagccgccgccgatatcaatcatggcgactccgaggtttttttcgtcttttgacaaagccgccgaaccggccgcaagcggctgcaggcagatatcagtaatttcaacgcccgctctctccacacagcgaagtaaattatgtaagatcgttttggagccggtaatcagcgtgccttctacttccaggcgcactccgagcatttttttcggatcggtaatttcgtctcttccgtcaacgataaactgtttcggaacgacgtcaacgatcagctgctcatgcggaaccgacacaacctgtgccgcttccattaccctgcggacgtcttcaacgtgaatttctttgttttcactggaaacagcgacaacgccgttcgtatcttgaatatgaatataatttccattaacgccgacaatggcttttttcagcggaaaacctaccattctttcagcttggtcaaacgcttttcttatagaatgaacggtttcatctatatcaacgattgagccttttttcaacccttcagacggtacatttcccactccgataatgttaagggaatcatctgtcatttctccgacgatcacttttgtattggacgtaccgatgtcaagactgacgtaaagttcattgttgttcattctatggcacctcctcacatttcgatcaaattctattctattatttgcggaacaacaatacaatgaatgtggctttacaagtgtgtaacaaaaacaacagcatcaacaaattcttatctgatttctcacaatttatgtttaatgaaactattcgttatattctatgtatatcctcttttatatcgcattttttttattttttttagagacggcccaccttaccgtaagatttcctgtcacggtgccataatgtgcaaaccagatgcaaatatacccgctttccattagtctacactaagatgaacctccagaaaagctatagatattgccagaaacatccgaaaaaagaagaaacaggaggaaaattccaaatgcaatgttcattgaagaagacacgcccattgcattgagaattttccccttgtccggcagccatatcccgggcaaaaacaaacatagtcataattattccgctatcggttatatcggctgccccgctgattgtaatagattcttttgaatcaccttaaaattagttctttagaactattaatcattttcttttttcttgccggatttacctttgttaaattcttcaaaatacgtagcgacttctaagtggataatcccctttttcccgccgtccagctgggaaacgatagaaggataggtcttcatccggtcggcaaatgttttaatagaagcggtaactacatacccgtcgttcatatacagcttgatccggtcctggtccatttttaccggtgtataatagatttcagaaatcgactgctttagcgaaccggaaagcttatcaagctgctccgccattttgacccgctttttcgcgtttgtccagtcaaccaaaatcgggcccgcgtcatccggcgtgacttcgttcggcagcacggtgccgttctccagcacttcataatacacatcattccgctgcagatacgcgatcgtcttgtattcttcaatgtgaatgctgactttattaggaaatacttttgaaagatccgcctttttcaccagtttattctgctcaatcttttcttctgtttttttcttgttcagactccagaactcggtttgtccgttatgtatatcagaaagcgcgttgatctcttttacagacacgttttcgttcccggaaacggtgacagaagacactttgctgatcggcatctgcaagtacacgatgatcagcaccatcataaaaaagagcacaatgaatgaaatcagccggcggtttgctttttgtttccgctgctctttgattttcggaatccgctcttcaatatttacgattttttctctttcatgatttgggttcactgcctgtccacctcactaagaatgaaacagcttgacattcgtctgattgaaaaacaaacggcatgctgtgatgccgtttgacatttgttaaaagtatatcacatgagctcatggaaatcagagaaccttttaacgattccctccgatgatttcaacttccgtatgcatgtcaacatcatactgctcacggattgtctttttcacatactcaatcaggtcgagaacgtccttggcagtcgctccgccggcattgacgataaaattcccgtgcatttcggatactttcgctccgccgatctgatgtccttttaatcccgctttttcaacgaggtttccggcatgattcggcagcggatttctgaatatgcttccggcgcatgggcttgaatacggctgcgtattttttctgtaatctttgttctgctgcatttgcgccgtaatggcttcccgttccttttgctcaagctgaagaactgcctcgagacagacgccggggcgttttttctgcaaaacagacgttctgtagctgaaatccatctcttcgtttgtcagccattcgattgtgccgtcttcaaataagatacgcgctttcacaagaatttcactcatatcagatccgtgcgccccggcattcatatagacggccccgccgattgatccggggatgcccgctgcaaattcgagaccggacattccttttttactcatggaagtcgcaagccggacgaccgaatagccgcctccgaccgtcacctgatcaccgtcaatctccaaatgatccagacccgcgcccagtttgatgacaactcctcttatgccttcatcaagcacgagcagatttgaaccccggccgataaccgtccatggcagatcatgtttcttcacaatatccataatatctttgaccgcttccacactgttggggatgatcaaaatgtccgccgggccgccgattttcatcgttgtatggttcgcgagcggttcttgttccagcactttgccgacttcgcggtctcttaattcctgaattacgttctccatcataaacctccgcattccatttgctctatttttttatgtcttccatgatactgtacagtctggctgccgcatccggaacaccgagtgattttgtccgctcactcatgtcttttaaggtttcttcattcatgacgattttgtccagcgcagcgatcagtttttctccgctgagctcggtttccttcagtacgattgcagcgtcatgctggctgagcgccttcgcattgacttcctggtgattggctgtcacatacgggctcggaataagcacgctcggaatgccgagagcggtgatctccgcaatcgtcgtcgctccggctcttgccacaatgacatcaattgattgtaagtactccggcatttggtgcaaaaacggttttgtcaccatattatcagcggcttttccgcctttcagctcagccgttaccttctcgtaatgcacttccccggtaatataaagcacttggtaaggtctcgttttcaattcttcctgcatatctatcacggcacggttaatgggagccgcgcctctgcttccgccgaaaatgagcaccgttttttgattgtctttcagcccgaactcagttaatgagcggcctgtcttaattgagacgacttcagaggctctcgggtttcccgtaaacacaactttttcagcaggaaaatgcgattttgcttcttcaaagcaaattgccaccttattaacatatttcgagagaaacttatttgtgatgccgggcaggctgttttgctcatgaatgatcgtcggaattcccatttttgccgccgcgtatacgaccggaccgcatacatagccgcctgtaccgataacggcatccggtttaaactcttttaaatatgatttgcttttcttcacgccttttaagaaacgcatgacggtttttacattttcaaaagaaagttttcgtttgaaacctgtaatttcaatggcgcggaacgggatattttcccgttcaacaatttttttctccagaccgttctctgttccgatatacaaaaattccacatccggatgccggcgctgaacttctttaataaaggccagggccggataaatatgtcctccggttccgcctccgcttactgcaatacgcattcgtatgtcccccttaatcacatagcgataaccctgttttttaggacagggttattgatgttgtctgtttttttatagataacgaatagatcatgagtgatgaggcaagatacagatcaatacctcgagtaccggctgacatttaaaagcacgccgaccgctgcgagcatcagcgtcagtgatgagcctccgtagcttaaaaacggcagcgtaattcctgttaccgggatcagccccgtcacaacgccgatattaatcatgacttgaatagctatcatagaaataataccgatggcgacaaagcttccgtataaatccggcgcgccgagggcaatcctgacgccccgccacaataaaatactgaacagcagcaatatgagcgaaccgccgataaagccgagttcctcagataaaatagcaaaaatgaaatcggtttgcggctccggcaggtaaaaaaacttttgccggctttggccgagccccatcccgaacagtccccccggacctacggcatagagcgactgaatgatctgaaatccgcttccaagcgggtcctcccacgggtttaagtaagaggtaatccgtttaatccgataaggagcggacagaacaagcgccgcaaatccgcttaaaccgatgagtccgaggaacgcaaaatgagcgattcgcgcaccggatacaaaaatcatcacgatgcacgtgcccaccattaccgtccccgttcccaggtccggctggcacataataataataaatgcagaaaacacgattccgagcgcgggaacgaatccgcgtctgaatgacgtaatattcttctgtttttcagaaagaaatttagccagaaacgcaatcatcgcgagtttcataaactccgaaggctgaatgctgaacgctcccactccgatccagcttcttgaaccgttccgcaccattccgactcccggaatcagcacaagcacaagcagaaaaaaacaaatgatcagaagcagcttcgaccatgtgcgccatgtccaataatccacattcataatgaaaaacatggcaatgacgccgatccccgcaaacagcagctgccgtttcgcgaagaaaaacgagtcgtcaaatttataatccgcccataccgcacttgcactgtagaccataattaatcctattgttaaaagcaataacgtaatgataactaataacaaatcaggcgctgtttttttagtagtcaaagcaatcgacaccccaagcataagtcatttagggctgccgatgaacagagacaagcccttacttaagcatatgcacggcatctataaacatgtcaccgcgttcttcaaatgttttgaactgatcccagcttgcacacgcgggtgacaagaggatgacgtctccttcatttgagagcgcaaacgccgcagatactgcttgttcaacattatcgacacgtttgacatgttgtattcccagctcattgcccagtttttctatcttcggcgctgtctgtccgaacgtcaggaccgctttgacattgtccatatacggtttcagatcgtcaaaaccgttgccgcggtccagtccgcctgcaagcagaataaccggtgctttgaacgcggagagcgctttgcttgtggccaaaatattcgtcgctttgctgtcattataaaatttacgattccggattgctgttacatactgcagacggtgtttgacaccggtaaagcttgtcagcaccttctgaatcgctttattagacgcgcccgccgtttttgccgcggctacagcggccaatatattttctaaattgtgcgcgcccggcagcacgatgtcatcaacaggcagaatcgcttcatcgccgaacatcagcattccgtctttaataaatgcgccgcttgacagttcctggtgcactgaaaacggaacggtgccggcttttccgctttcggcaagccgcacgactgtttcatcgctttgattcacgatggccgtatcactctcaagctgatgaagatacacgttctgcttggctttttcatagttttcacggctgtgatggtaatccaaatgagcgtcgaacacatttaaaatcaggccgatttcaggtctgaacgcatgagtccccataagctggaacgaagaaagctctgtgacgatccattcatcaccgtcagcatgataagccacttcactggcgacagtgccgatatttcctgcgatcagcgcctttatcgagtcagctttcagcatttcataaatcagggtcgtcgttgttgttttcccgtttgaacctgtaatgccgatgaattttgcattggtgatataatacgcaagctcgatttccgtccaaaccgggatgcctcttctttgcgcttcctccaccatgatattttcatacgggattccgggatttttgatcagaatggtaatgtgatgctgatcaaaaagtgacgtcggatgctcaccgcagatgacctcgattcctctttctgaaagcctttgggcaggttcgttctcttcaaaggctttttgatcattcacgacgacgttaatgcctttttcatgaagaatcgacgcagccgcatatccgcttttcgccagtccgaggaccagaaagttttgttttcgcaaaaaaagttcgttttccacttataaccacacctcgatgtaaattcctaaaacggcaagcagcagtcccgcagtccagaatgtgacgacaactctccattcagaccatccgaccaattcgtaatggtggtgaagcggactcatcttaaagattcgttttcctgtcgttttaaagctgatgacttgtaagataacagataaggtctcaataacaaaaactccgccgataatgacgagcagaatttcaagcttcgtcagaatggcaacggtcacgatcgctcctccgagcgcaagcgaaccggtatcccccataaatactttggcgggatgggcgttgaatacaagaaaaccgagaacggcgccgacaacggcaaccgagaaaatcgcaacgtcatattgtgactggttccacgcaaggatggcgaaagcgccgaatgcgatagccgcggtaccggacaagagaccgtccagaccgtctgtcaggttgacggcatttgaacctccgacaagcataaagagaacgaggataaagtatccccagccgagatcgattgacagatgtgtgcccggcaccctgatgccggttgaaaaatggcaataatgatatactccgtaaaatacaatggcaataatgatctggccgatcaatttctgcttcgacgtcaatccgagattccgtttcattactactttaatatagtcatccagaaagccgagcaggccgtatccgatcgtaacaaacagcagaagaaacatttccgcgctcagatgcgaaaatttctgcgtcatgacaatcgccgtaatagcgatggatacgataatcatgaccccgcccatcgtcggcgtccctgattttttcatatgtgatttcggcccctcttccctgatactttggccgaattttaaacgtcttaaaaacgggataagaatcggagatatcagaacactgattaaaaatcccattattattgtaaataaaatcacttgctcaagcattgctcttttctcctcccgtttcgttcaaacgacatacgtatttatcatattcacattgtgtccccgtaattcttttcatttcactcattctaacactctttcctgttttactttttattcagctcaacaatagctcttcccgctacttcggcgtcatcaaagtcgaatgtttcattgccgatctgctgataggtttcatgccctttcccggcaatcagaaccacatctccctttttcgcgttggcaatagcaaaaaagatagcctgctcgcggtttgcgatactgtgatagtaggtgccttctacccctctttccatatctcttaatatggccagcgggtcctcgcttctcgggttatctgaagtgaaaatcggttcgtcggcaatccgcaccgcaatttccgccattttcgggcgtttcgttttatcccggtctccgccgcagccgacgacgacgaaaagcttgccctctgtcatgtctttgcatgtattcagaacgttttccagactgtcaggcgtgtgcgcgtaatcgacgaccacaggaaacggctgattatgattcaccagttcaaaccggcctctgacaccttgcagctcttcaagagcgctcgtgatcgtatcaaacggcagacccgctgcgatcgctgtcgccgctgcagccagtacgttatacacgttgaagcggccgacgagtgaaaccgtgatctgctttgttccttttggcgtaacgagttcaaaatttgtgccttgcgcagagatctcgatttgtttcgccatgacatcggcatcgttctcgattccgtatgtaaggatgtgcgccgccgtcactttttcaaaataagcactggctttgtcatctgcgtttaaaacggcccgcttcggcttttcatggttaaaggagccgcccagctgggaaaacaggaggcttttagcctgtctgtagtcttccatcgtcttgtgatagtctaaatggtcctgcgtcaggttcgtgaatacggcgatatcataatcgcagccgtgaaccctgccgagtgacagagcgtgagaagacacttccataatagctgtgtcaacatgctcatcattcattttcttgaacgttttttgcagtgtgacgctttcgggcgttgtatttttgaccgggaatgtctcatccccgattttaatgtacatcgttccgattaaaccggtctgtcttcccgcttttttgaaaatctcatcaaccatgtgcgtcgttgatgttttgccgtttgtgccggtgatgccgataagctgaagctgctttgtcggctgcccgtaaaacgcgtcagaaagaacgctgagcgcccgctgtgaccggcggacgataatgacaggaacatcgacgtcaagctctttctcggcaacgatggccgctgcgccgttttctgcggctttttgggcgaaatcatgtccgtctaccgtatacccttttatacacacaaaaagactcccttttctcacttccctggagtccatctcaattgaagttatgtcagggtcatgaaagtcattttgaacaggttcggccattaaatatgtaagcagctttgtaagtttcattgtatcaaacctctcagaaattctattcattcttttatcatgataaccgtttataaaagtcagaatggcttttaaacatacagttcatattttagcgtaaataaaaggatacatccagttaatcttaaaagttatcttctttttttctctttatgataaaaggcagccgaaaacaatcggctgcctcaaaaagactcattcttcactcaagtaaacacggatctttgagccttcttttactttcgttccggctgcaggtgattgtttcacaattttgcttccttttcctgaggagtcaatattcaaattgacaagcagcgactcaagatcagagacagacatccctacaacattcggaacctctattgtttttgtgtcgttccattgatattttttctcgatttgattttttcgcggtttcacgccgagctccggcagactgtctctcatcatatttccgacaatcggcgcggcgacggttcccccgaattgaatcgtgcctttcggattatcaaccgcgacatacacgacgaggctcgggtcatcagccggcgcaaaaccgataaaggagacgatatggttgttttcgagatatttgccgtctttgaccttttgtgcggtacctgtttttccgccgacgcgatatccttccacgaaggcattccgccccgttccctgagcgacgacgctttctaaagcatatctgatctgctttgacgtttcctgggaaataacttgccttttcgcaatcggcgattgtttcttaactgtttttttcgtaacgggatcaacccactctttggcgataaacggagtataaagcgttccgccgtttattgctgcggaaacggctgccacctgctgaatcggcgtgacggaaaccccttgtccgaaagcggttgtcgcctgttcgaccgggccgactctgtcaagcgggaataaaatccccgttccttccccttgcagatcaatgcctgttttctttccaaagccgaagtccttaatatattgaaacagcttttgttttccgagccgttcccccagctgtacaaacccggggttgcaggaattttgaacgacttcaagataagattgcgaaccgtgaccgccctttttccagcatcggaggcgggcgccgtcaacctcggcaaatcctttgtcataaaagtggtctctttgcaagtttactttttgctcttggagagccgccgcaagcgtaataatcttaaaggtcgaacccggttcatatgtgctccataccggcaggttccggttgtaaacggacggatctacggattgatagtcagccggatcaaaatcaggacggcttgacataccgagcacttccccgtttttcggattcattgcgaccgcaatcattccgtccggattatatttcgccgctgcattatcgagctctctttctataatcgtctgaaccttggcgtcaatcgtcaatttcatatcaagtccgtctttcggaggggtgtaatcatccgcttcatcaggcattttcttccccttggcatccgtataaaatttcactgatccctttacaccttttaagtcatcatcataataagcctccaatccgagaaggccctggttatcaatacccgcaaaaccgagaacatgggacaaaaagcttccgtacggataatggcggatgctgtcttcagccacataaaccccttttaagtcgagcgctttgatttctttcgcttttttattggaaattttccgcccctcgggtgagattttttctatggaggttttcttagtaatgtgtttgtagaccttctcttccgacatatttaaaactgacgcgagaagcttgcccgtttttatgggattttgaatctggcgcggtacgacaaagacggtcggcgcgcttttattcgtagccagcttcacgccgtttcggtcaaggatttctccccgctcaggctcaaacggcaaattccggctccaggaatccttagccagtgaagtcagcttttctcccatcacaaattggacatagcctaatctgctgtcaatgatcaaaaaaatgattacgccaaaaagcaaaaccagtaataaacgttttcgaaccgttacatttgaaacgcgcaagggaccgtccactccttatttaggcttgtttcaatttatgcctcagcttggacacatagaacggcggcgcataaaaaagaagcccgcgggcatccgcggacttctctgtcccgttaatcaggatttttaaatttcaccttgatcacggtattttctttcagttctttgccttttttcacactttggcttgaagcgtaaccttcaccgctcacatcgatgtgaatgcctgatactttgctgaattgaagcacttcccgtctcgaccatccggacatatccggcatcgtcatctttccgtctgtttttaagaagattttctgattggtgatcacatcttctccggctgtcggatactgctcttttacggcaacatcgctgccgatgacaatcggtgtgagatgttcatttttcgcttccttctcagcgcccgtgactgtcttatctgtcaggtcaggcatcttttggcttttcgtttcttcctgaccggaatctgttttttccgtcggttcgatattcatgtagtggaggctgtttttcatcgtcgggttaaagatttccgcgacaggatcagagctgctttgacccgcttttaactgcggctgctgcacggctacatagatgacgagcttaggatcatttttcggcgccatgcccatgaatgaaaacacatagttgctcgttccccttaaatatccgcctgtcccggcgatttgtgcggttcccgttttacccgcgacgtcaaaaccttcaattttataaggttttcccgttccgatgtctgacgtcacgacttctccgagcaggttccggacttttttcgccgtatcggctgaaatcggcgtgccaacttgctccggttttgtctgcttgacgacttttttcgtatcggggtcgacaatatgatcaatgacgtaaggtttcatcattttgccgttattggcaatcgccgtgacggcctgaagctgctggatcggtgttatcgccgatgcttggccgtaagccgtagacgctttgtcaaaatcatatttgtagttaattttacttgatacttcaccgggcagatcaatccctgttttttgatagagcccgaatttgtgcaggtactcattaaaccggtcaaaccccagtttttcgttggccagtttggcgaaagcaacattcgatgacctcatgaggccgtcatggaagcttgtcataccccatccggcgccatcgttccaatctttaacaggtttgcctcccactttatatgttcctgatttatatttctcgtttgcggaaaacacattttcctgaatcgccgcggcaagcgtaaagatcttcatcgttgaacccggttcatacgcgtacgacactaagtcgttgtaataattggtgacgtttctgatattcgggtcaaaactcggacgctgccccatcgcaagcactttgcctgttttcggttctacgacagccgccataatttttttcggtttatatttttccgctactttcgtcatgctgtcttctagaaaggtttgaattttctgatcaatggttaaatatacattgtcaccgtttttaggtgcggtgattttttctttgctgttcggaagtttccagccggatttatcactttcgtaagtgacggacccgtcacgttccgtcagatagttattcagtattttttcaagtcctaaagagccttgtatctcgtttgttttttcattcacatcggcatagccgagaacatttgacaaaaatatgccgttcggatagtagcgcttcgtatctcttaagaaagaaatacccggaagatccattttttcgatcttttgttttttcgcataagagatatcgcggccggctgaaccgaattccacctgcttcgcgccattcctgtttaagatgtccagaatctcgcttttatcaagattgataacggtcgccagtttttccgccgttttctctttgtctttgacatgctgaggatgcttcggatcactcgtcatttttttatcaagcacggcaatgagcttatatgtcgccgtgtcctctgcaagcactttgccgttccggtcaagaatagagccgcggctcgcttctatcgtccgctttttttcgtgctgctcggtcgcttttgttgcaagttctactccgtttgctttaccggttaattgaatgtacgccattctcccgagaatgacaaagaaaaagagagcgaaacaaatactgagtatcgctgctcctctgttcataaacttattttttttcggcatgggttatcattcctgtatgtttttcacttttttatctttcagattcaaaccgtgctttttagcgatatccatcaggcgctgcggctggcttaagtcagcagccgtcttttcgagatcaccgatctgcttattcttctcagatactttctcctccagtttttgcacctcaatattggattggtacgccgcgtatgcctttgatacgataaacattgatgtggagagaacggcaatggcaaacaggacgagcagcaccttttccccgagtgtaatggaagccctctttttgacaatcacctttttttcgggacttatcactggccgttgttgtttttcctgctggtaagctaagttgctcataggctgatgacctcctttaatgttgtcatttgctgcccgttattttcgtttctccgcaatgcggagcttcgctgaccgggcgcggttattttcttcaagctcctcttttgatgccgtaatgggctttctcgtaatcagttttaattccggttcaaattcttccggtatcacgggaagacccggaggcagttcgggaagtgatgatttttccttgaatgtcgtcttgcacattctgtcttccagcgagtgaaaagtgatcacagacacccttccgcccggcttcagcacctctatcgcttgcaagagggcctcttcaaatacctgaagctcgtcgtttacggcaattcgaatggcttggaatacacgtttggccggatgacctccgcttcttctcgccggagccggtatcgcgtcctttattagatcgaccagttggccggttgtttgaataggcgatttttctcttgcctcttcaattttccgggcgatctgcttgctgaatttttcttctccgtatttaaagaaaatcctcacaaggtcctcataccgccattcatttacgacttctttcgccgtaagggcggccgactggtccatcctcatgtccagcggtgcgtcatgatgataactgaatccccgttccggtgtatcaagctgcggagaggatactcctaaatcaaataaaattccgtcgacactcgtaatgccgtgttcatgtaaacactcttttaaataacgaaagttgctttttaccagaatgagctgtcctttgtattcggacaatgttttctgtgcgttttcaagcgccgtgtcatcttggtcaaaggcgatcaggcgtcctttttccgataattgctgcaataaatatgtactgtgcccggcgccgccaagggtgcagtccacataggttccgtccggtttgatatttaaaccgtcgacggtttcacgaagaagtactgtcttatgctgaaacatttgtgtcggtcccacctttatcaggaatgaattgaattgtcagttgttgttgtgatgcacgaagatccattatatatcaaatccaatcatgttttcagcaatttcagcgaatgaatcttcttgctcttctgtgtattgttcccatattaccttactccacaattcaattcgattggaaaccccgatgacaacacattctttttccagttttgcgtaattcagaagagatgacgcaatattaacccttccctgcttgtccagttcgcattcggtcgcaccggaaaaaaagaatcgggtaaatgcgcgggcgtcttttttggtgagcggcagagccttcagcttttcttcaatcagcttccattcattcatcggatagccgaaaaggcattggtcaagtcctcttgtcagcacaaactgctcaccgaggccttctctgaattttgcgggtacgatcatgcggccctttgcatcaattgtatgctggtattcacccataaacatgataaggacccccactttctcccctaaactcaccactatccgccacttctctccacaacctcattttacactgtttacacataaaaaaaaaccctgaactattcagggttctttaaaactttatttcaaagtttgacaatctgatgttggttttgaaaagaaaatggcagatgtttgaaggttgtgaagaattttggaccataacggttcaaataatacattacattccaaatccgttcctgcggagcgccgagcggtctgatgctgttttggattctttcatagtcacgcagcacaaaaccttctttttcttcaattcttttcgttaccgtccgttctaaaaacaagagctgatcctgaatgaaggcggcattcttctgtaagagcggctcaaggcttgaatcgaccttcagcgcttcgttccttgcgcttttatggacagcttcaatctgcgacttcgcctgttccattacagaagaaaactcttccggaatctgctcttcaaaataagcgtctttcaggtgtccggtgccgtgttcgatcgcttcctgaagcggaatattccgttctgaaagcttcttttcaatatggcgctcaagaatcgtaatgttcagtctcggcactaccggcgtcatgcggaagcccattaatgagaaagcctgcttcagctcaccccaataattgatctcccccggtcccgcgataaacgccagagtcgggatgagaaactcctgcataagcggccttgtcacaacgttattgctgaaacattccggtttttcttccatatgggtatgaagctcgtcgttcgtccacttcaggtcaagctccttaatgacaaaaacgccgttttctttttcaattaagaaacgctctccctcgtgttcgtaaaacagattagcctgatctttgtccgattcaataatcgggtgataaccggcttcccgcataagacgctgctggtctgacacggctttgacaagctcgtgattgtgttttaaaatctgctgaaacatacccgtttccagctttttaatccccggatctcccgaattcatcagaataaggccttcttcttgaaacaagtcggcgatcaacagctcaaaaaagtccgtgaatgtctctgatgagcgtaaacatcgcttcacgttttgaaggagtgtgtttgtgtgatccgtttcctcaaaagcagcgaacacttcatcaatccaagccgcgcatttttcctgatcaagctcggttttagccgccgatgtttttttccagtacgactgcggcagtttccgcttcaccggacctttattctctgttgacgtatgcacataattaatttcttccagatcgtgatcttcacccgccacccagaaaatcggagcgacaggaatctgcagcgcctcttcctgctgtctggcaagtacgataatggagataattttatgtatggtgtaaagaggccccgttaaaagaccggcctgctggccgcctacaaccgctgcgctttttggatctctcagtttttcgatggaggcctgcatggcggcggagtgaaatttttcgtgataggaggataaataatccgctaattcctctctggcaaacggccgcgaagagaggtcatgaagccgcttttgccatacgtcctctgaatgaatatcataatcaaaaaatgaagacatgttttctccatctatatagtgctgcacaaacttattttgacttttgatggaaagttcagttagctgcatctgtctggaacttcctttctccaataaatagttaggtttccgaaatgagtatagcatgttaccggaaaacctcaaaagactttgtttcaatttctttctaacgcttttatgctgcggtgtaaaaacgtgagatgaacggccggcaatccgcggctttccgcttcttttacaaggtagccgataatcgcatcggcctcggtccgcctgcctgccatgatatcgacgagcatggaagaatgatttttttccgtcagtctgcaaacttcgcaaaccttgttccacgctttttctctatcggcgaggccaagtattgtctccgcttcttcaaacacgtttctcatatattttttgtaagcgtcatttcttaacagctctccgtttttcacgcgcagcaatgcagttaacgggttgatgcatacattgatgatcagttttcccgttaaaagccgataccagtcgttttcatcatatacgggaaaatcccggtgcatgccggaaaagatgcttttgagcgtttccggccgggatgcgctgaatacactccatcttacggctcccgctcccgtatgttcaacggcatgatccgatatcttttttgctccgtgctcaactgtgccggcataaagcgaatgatccgtatgccaatctctaatgtcgtgtatgtgtcccatgccgttttgcaaaaacagcacattcgtcccttttaccgtctcaagatcccgcagcacagcactgagctggtgctgtttaacggctgcgattaagaggtcgaatccggaagtgatgcctgtttgcgctctgcatgccgccgtacattctattccgtctttcaaaagccgtataccgcctgagttaatcgcatcagcctgctccgtccgccgcgtaatgactgttacctgatggcgggacgataagtagtaagcacataaaaggcctaccgctccgccgccgataattccgattttcacactgtcacaccctatatctgcatttttccatattatcatagcagaagccgccgcaaattacttcaatttcgttttgagcaaaaagacaggcaagcatattatagttggaattttcaattaaagcgtttacaataatggtagaacacaacaaaggggagtttgtgttgaaaatagagcgcctgctcatcaactttaagacactcgaagaatttaaaaggtttaaggaatacgggatgcaggagctgtcgatgcttgaagatcttcaggataatatcattgaaaatgacagcacctcgcctttttacgggatttacttcggggataaactagtggcgagaatgagtttatatcaggtaaacggaggcgcgaatccgtattttgatcagcgtcaggactttttggaactttggaagcttgaggttcttccgggctatcaaaacaacggatacggaaaagcgcttgttgattttgcaaaatccttcagaatgccgatcaggacaaattcacgcatgaaatcagcagaattctgggataagatgaattttgagcccgttaaatatgatatggcgcgtgataaaggagaaaatccttacatctggcatcccgatatggacggtgaaatgacatccggagaaacggcataataaaaaaccggccgggccgccgccctcaggccggttcattttacaggctctgcgccgatttcctgtcgtcttcttttgaattgaccatccttctcgctctgtccataatgtcaattaacgctttataatcttcttccgtcatctccagcttgtttctcaagctttcattttcctcacgcagatcctcgacttctttttgcagcgcggtcagctgttctgtgagtttttctttttcatgacgcacatccgctgcggccggcgactctttaaattgctgaagaaacaaaatgacatcatcaatggacagctctttttctccttccgccctgcggatcggaggctgtttgacggttcccggcagattggcggaatgcaccccgatctgctttcttaattccttccgctgttttttcgccagttctatccctgactgatattgttttctgacataagaattccatctgaacccgcaggcggcagccgttctcgtcagcgctctgccgacttcttcaaaagcggaaagctgggtcccgccttcccgaatatgcctgagcaccacttcggccagcagcaaatcttcatcttgcgtccacgcgtcttgtctcgttatcgtcaatcgtatctccctccatatttgctcatttacctcatacatatgccgctgatagattagatagactactggcgctcacaattttttcggcggaagcaggccggaggggcaaaaaaaaagaaaagcgcaggaaccgagattcccgcgcttttcttcatacattaattgcttttaacatttatgtctttgccgttgtatgatccgcatgctttacatacacggtgagacaatttcatctctccgcatgacgggcattctgtcataccaggtacatttagtttgaaatgtgtacggcgcaatctttttttcattttagaagttcttctaaaaggtacagccattattcccacctccttaaagagttaagattcatcatcttgtgttaagagctttttcagatccgcaagtctggggtcgatttgatttttcttgtcttcctcagaaatcacttgccaatccttccccacttggggagcggctccttctttttgttcagtttcacaaaagacttgcataggaatttctaaaagaatctcttcttttacgatcggagttaagtcgacgatatcgtcttcagcaatatgaacgtcctcatcttctatatcatccgacttatgaaatctaaacagttcttttgtcgcgattgtaaatggatacggcacatcaactaaagttcttgagcacggcaaaaccatttcgcctgaaatcgtaaagtcaaacgaaacttgcttggattcaatctccgcgcggcccttcacccggacgggagaaatgcggcggatgtcagaattcaattttgtcagctcatttaactcaactgtttcatcaaattcaaagctctttttcgccatttgatgaagctgataaatcgtccatttcatttgtatcacctcaggaaagcaacaaacatgattatagcttttcagaatgtttttgtcaatattttttctttacagcataatgccgccgtcatgcaatcgttgacagccggataggctatgcatacactaaacgaaacggactaaaatatgcacttcatttgcaaatgtaccacacgaagcaaaacatagcaagaaaggcgggacaaatatgaaagcagtcggcctggttgttgaatataatccctttcataacggacaccgctatcatgcggaacaagcaaaaatcaaaacggacagcagcgtcgcggcggcggtgatgagcggcccttttttgcagcgcggagaaccggccgccgtctcaaagtgggcccggacaaaaatggcgctggaaaacggcgtggatatcgtcattgagctcccttatatgtatgccgtacaaaaagcggaattattcgcgcgcggcagcgtttcgcttcttcatcatttaggatgcagcagcttgtttttcggcagcgaaaacgggcggatcgaaccctttattgaagcgtctgaagcgttcagccgaaaggaagatgactgcagcctgattctgaaagaggagctgaaaaagggtctcagctatccggccgccgcctcaaaagctttttcacacatattcaaagggcgggacatgctcgatttgtccaagccgaacaatattctcggttttcactacgttagagcgatacacgccttcggttccgctatgaagccttatacgacagccagaatcgcttcccagtatcatgacgccgagcttcccggagataacagccggatagccagcgcaacaagcatccggaaagcgctgatagaaaaaggaacggcggccgcaaggagctttctcccggaagcgtctgcgcgtgagctggaggcatacagaaattcatacgggatatggcacagcaccgaagactatttttcatatgtaaaatacagcctcagcactctgtccgctgaagaattgagccgaatctatgaagtggaagaaggccttgagcacagaattctgcgcaccatcagacaagcccgatcctatcgcgaaatgatggaacgattgaaaacaaaacgatacacgtggacgaggctgcagcggatgaacacgcacattctgacacggacgaaaaaggaggacatgcatcggctcttacagccttcaagcgctccttatatccgtcttctcggaatgacgaaaaaaggacaggcgtacctgtcggcaaagaaaaaagagcttaccgcacctctcgtcagcaagctctcttctttctctcatcccgctctggatctggacatactggcgggacgggtttacagcctgccgataaaagaacctgaacgcacattttttgagaaacaggaattttcacaagcgccgatccgctatgatgaagacgaacagcgttttttgaatgcgtaaaaaaagcacctgcctgtatcaggtgctttttactttcagatgatccaaatagtcaagtgcgtcctgcatggtgtcgacagggacgatcttcatatcggacttgattgctttcgccgtttttaccgcatttttgtaatcagaattttcagctccgttttgattcggcgcaaagaaaatatcttttcccgctttgtctgcggcgacgactttctgatcgattccgccgatcggtccgaccttgccgtccacgtcgattgtccccgttccggctatattatagccttttgtttcgtcaggttttgtcagctggttgtaaatttctaaagacatcatgagacccgcagaaggcccgccgatattttcaatgctgaaatggagatccggctttactttcacgttccgatccgtatataacgcgacgccgattcccgctcttttcgggtcgtccgggaatgatttcagcgcaatgtcaacggtcttttctttcgtgtcccgttcaatgtgaaacgttactttctcccccgcttttttgctgctgatataatcaatcagcttttcagcggattcgtatgttttcccgtccgcgctgatgattttatcaccgacctctatttttccttttgccggcatgtcagagacgactgagctggcgaaaatcccgttaaatgagtatttcacctgtttcccggctttttgataagcggcaatgaccgcgttttcttgggagcttttcatcatttgcagctggcgcttcatataatccgagtccgattcgccctcttcttttatgctttcatcagggacgatttcatcgtaaggatgcactttcgcccaaagatatgtatacggattggcggggcctactttgacagtcatcaaggaaaggcttcctttttcaggatagcctccgtccaccttaatcagcggtctcagctctgatgcttctcccggctgtgtaatgtaatacggaagcttaataaatgtaacagcaattaataagatcaggatgataaacacccagcgaaaatgttttgctttcatatgagttagccctcccagttctctatttcttgtttaatccggccgatcatccggtctgcggcttcttcgcccgctgtgatcatatgatcaatgttggcaaaagaacttgagctgaatgattcaagagaagggcggatcatgacgtctgcggcaatggtctggtgacggaccaattcattttgcagtatatccatactttgcatgattacatcaaaaatatgtgccgctttttccgtttttttcacccgggatacgtcagaggcgatgacgatatcagcacccatgtcttttacggcggacaccggtattctgtcgaccaccgcgccgtcgactaacatacgtccgttcattttttgcgggacgaaaacgcccggtatgctgatgctcgcgcggacggcttcggatactgaacctttcgtaaaaacgagtttttcgccggtctgaaggtcgcaggccacgatgccgagcgggatccgcagttcttctatcggcttgccgtacgtataggcatgaacgagctgcctgatgcggtctccttttaaaaatccgagcctcggcatcgtataatccgcatacagccgccgcttaaatgctttggcgacttttttcatcgtagccacgtcatgcccggccgcataaaagctcccgactaatgctcccatgctgctgccggcaatcatatcaattggaatctgatgcttatgtaaactggataacactccgagatgagcgatgcctcttgcccctcccgaacctaacgctaacccgattgtaggtttggccaacgcgacgaaccccctaatagacatcctatacatgaattctatggtctaaattgaacccctatgctcgtatattagtacaggatgacaaataggtacttgcccggccgcctttaaggtctgttctatattttatcatgatataaatgtcagtgtgcaattttagcatcggggaggtaagaatgaatttgtctaagtttcatacatttttgatttcattgtttttcatttttttgacggcgacggttatttcacaccctcaggcctcattcgaagcctccaaaaccggtctttccatgtggtgggaggtcgtttttccttcattgcttccgttttttattctatctgagcttttaatcggattcggcattgtcaaatttgtcggccttttactcgaaccctttatgcgtcccattttcagagtgccgggggtcggcggatttgtactggctatgggcatggcttcaggcaatccggccggcgcgaagctgactgcacggctgcgccaggataaacaaatctccagagtagaggctgaacgcctcgtctcttttaccaattcatccaatccgttatttatattcgctgccgtggcggtcggcttttttcataacgcgtctctcggcattctgctggcatcggctcactatcttggaaacatcgccgtcggcctgacgatgcgttcatacggacggaaagaagaagcggcgtataccggtaaaaagacgatcgctctcccttctctgaaggaagcatttctggccctccacaaggcgcggctttcggaaaagcggccgctcggaaaaattttgggcgacgccgtcacctcttctgtacaaaccttgctgatggtgggcggttttattatattgttttcggttttcagccggttattatcaatcgtacaagtcatggatgtgctttctgtatttacaaacgcgctgctttccctttttcatcttccggcaaatctggacatccctcttatcagcggaatgtttgaaattacacttgggagcaagctggtcagtgaagctgatgccgccttgctgccgaaagccatgattgtgagttttattctcgggttcagcggcctttccgtacaggcccaggtagccggcattttatcggaaacagatatccgctttaaaccgtttttcgcggcgcgtatccttcagggcatttatgccgcactctttattctcttactgtggaagccgctttaccttgcattggacgaaccttaccagtccgtattcctccctttccgcgatcaggacgcgggatctgctgccgtcagcggatggaatacacttgttgaaaccgggcccgccatcacgctgacagctctcgccgtatacgcattgatttattgttacaggctgtcagcacggacaaaaaaaggatgagacgccgatcagcgcttctcatcctttaaatttctgcttcagcgcctgttcaacttccggaggaacaaactctgaaacaggcccgttatattttgcgacttcttttacgatgcttgaacttaaaaaagagtactgattgttcgtcatcataaaaaaagtttctattgattcgtcaagcacgcggttgacggaagtcccctgcatctcatattcgaagtcagaaacagctctgagccccctgataatcgccttcgcccgcttttttttcgcatagtcgattaacagtccctgtgacgtctcgaccgtaatattcggaatgtcttttgtcacttctcttaacagctcacagcgttcctcgactgtaaacagcggctgcttagaagaattattgagcacgcatacgtacacctgctcaaacacgtttgccccccgtctgataatgtccaggtgtccgtaggtgacgggatcaaaacttccgggacatacagctatacttgccacatcattaccccctatttcggtatatcgtcactcctgtaagcccgtaaatttcccttcttgttacagaaagcgcgccgacggcttcaggaagcacaacggctttatcatgctcggctacgacaaaaccgtcttcattcagcatgttctgctcatcaatcatttcgataagcgctttcagcttttgttccttatacggaggatctaagaaaattccgtcaaaacctttttcccgtttcgccgcggcatagagggcccgctctgcatcattgcggtatacttccgatgaagacagcagatcgagcgctttgatattcgcttttaccgtttggatggctttgaaatcacgatccacaaagatacagcggtcaaatccgcgcgacagcgcttcaatcccgaggccgccgctccccgcaaacaaatccagccctgttcctccgtcaaaatacgggccgatcatattaaaaatagactcttttactttatccgtcgtcggccttgttgatgtgcccggcaccgcctttaaggctcgtccttttcttgaaccggaaattactctcattattcacaccactttttctgaaaactttgatgtttctcatcggctgagccgttatgtataaaaacaatccctatcttatcataaagcattctttcaaacaatgaacgtgaaaaacgtgtatacatattcacattcctgtcaagactacgtgtaacagcatcaatgaatgatgttgttgccaaccgcggagaagacttacgtttccccataagttcttcctccggtttctcctctcccttttccttctccttaacttgttaaggaatagaaggaccccgcaggtatctgcggggatttttttatataccgactttataatcgtactctttcgctttatcaagctttgattcaaattccagctttaaaaaaggtttataagaaggctctaccttcttcacataagaataagaagaaatcttttccattgttttttcgatcaggtccatatcgcaatacagcacaacgtatttcagccgcttggaaacataatgaacgttgccgaattttctcagcattttgctgtgttttaaagaatgcagatatacgattatgccttggcgcttattttccatcatgatcacccgcctgactttctgttcattttatgtaaaagacgagacggccgtctcgtcaggaaactttgcatccgcagccgccgccggaaccgcagccgccgccgcaggatgacaggccgtcaaaataaggattccccgtcggcacttttacatgctccgagacggccgttccgagttcaatgctgatctcgtcaagcagcgactgaagctcagtctccgcttttttaaattcggccaccttatcgtttaaatcgagctcccgcttcatttctctcattttgcgggaaatctctctataatcaggatggtatttgccaaagcgctgcacatcctcatactgctctttaacgctcataaaagaacgaatgatccgccctgcctcttcatcttcacggagacgcttgtaacaatcgcggtaattttcagccgtctcagactgcagaatcatgccggcaagctgttccgcttcactttgaagcttgacggactcaattgttgcatacataaatacgcacctccagttgctagtttaccatgaaaccacccaattggaaaatgcggcgtttaaacgctttttaatcctgcgaacgcatggcgtgtaccatctgcatcatcatctgcgccatttgaatcccgtttgagaattgacttacccgatgcggtatcgtcttttcataaaaattcatcatgtcaagctgaaaggaattgagatcgtccggttttctcgcaagtctgcggtaccagacgggacgctgccgtataaaccgtttccgttcctcatctgcggatatgaattcctgaacctcttttcgcatacacgatccccttctttaatcctttctgaatgaaaaaggatgttgtccggagccttgccggggctgcttcgtgctgctccccgaaaattggcttaaaaggctttgcaatgatgaaatggactggctcattttattgatctgctcattcatttggttgatatccatctttttgacggcagtgaccatttttgaaacgaaatcgttcttttcagctggttcctgtttggtttccgcgtcggaagaaggctgaacggcctcgtctttaaaagggtcccacatcgaatcatcctcgcccaggagaacccagttttcatagacttcctgccagcttctttgttccttgcgaacattttggatcagtttgggatgcttttttacgaattgtttaaaatcatcgattgattgccgtgattgctgattcgccacaattctcaccccctccgaaaagttttgcctgctataatgtatcggttcatgcgccttaatgttcgcctaaattgcgaaaaaaagcaggtatatttttttcagcaggagcgccgctcgcgaaaaatcataaaaaaaccgcgggggacgcgcccctctgcggttttttactgccaaggcttaatgaagttttgcgtataatacttccggtccacgccgacaccgaggtgcgtataatccgggcttaacagcgccttcctgtggccttcgctgttcagccagccctccacggctgcaggaccgtccacatagttgtaggcaatattttcaccggcctcccggtatttcacatcgcctttttccaagcggtccttcagagtcccgtatttctttgagacgtgagagaaatacttgttatccttcatgtccttgctgtggccgaatgccactttcgcggcgccttcgtcccatttcagccttgccagtccgtgtttcacgcggatgacatttgtaatgtcgagaatctgctgttcactcgctcgttcaatgtcgttccattttttatcagaaactggctcgggttctgtcagctttcctctgtacatgacctcatacggcctttgtttcaccagcgtttccgcatcaaaagccctgatgcttgacagattcccgtcaaatttgtccatgtacagctgaacatacattccgcctatcttgacggtgggacgggtattgatatcttcttcggaaaactcaaaccgatacgtgtttcccttgtcagtcacattgacaaaaggagaaacctgcgtcgttttaaaaacttcgcccgtcgattcgccgatcttaaacggttttgcgttgatgccgcttcccgaagcgtataaagtcacggctttatcattcaaaataccgacttgtacgtattggtctttcccctggttgtacacccaccactcgtaatcgtaggcagaaggatctttccgggacggttccccaagtttctttttcacatcggcggcagatttccccatgagagaaagcagtccggatgacggcattttcagccgttttccgctctcttcttcattggaaacctgaggctcctcctgattggtctttttctgaggagccgatccatattgtataaacagaacatacgctccgtaaataagcaaaaggataacgagagcccttgcaatatttttcaacctctcacccccatatcatcaaaccgttctgtttttgtgtactcttatacagtacagcctatttgcatcgtccgtgatttatgtttaatggataaacccctccggacctccgtcttcagaaatgtcagacagcgcccggcctgcttgctcatttgattgctcggccaacgaaagatcgccgagcgtaacaatgccgaccagttttttatcccttgtgacgggaattcttctgagctgatgttcagccatcaaatggagcacctcctccacagaggcgtcttcttctgcactgataacccgctctgtcattgcgtcggttattttttgagagttcggcttttttgaagcaattccccgtaatacgagatctctgtctgtcacgatcccgacaagtgtggcgccgtcttcatccactatcggaatggcgccgacatccgcgtctttcatcttcaccgcagcttcatatacattatctaatactgtacaatattgcaagtctgacgtcatgagcttattgatctttgtcattgcggaattcctccttttttctgctactattgtcgtcaaatttttgtttttgcatactttcaccgtatgaatcattgaaagtgtaacgctttcatactatgattgtcaggaaagggcatttttaaaaggagggggaaggtttgaagtttgaaaacagcggtcttgaaggggtaacagcggagctcagccgcttgaacgatctgatggaaggcaaagggctcattctggctggacaatgggattatgaaagagtgacttacgacaaaaagttttcagtacctgaggggacattttatctgcggattcaaggaacggcaaaagagggcgatgtcggcggcagacgggccgtgattcagctgaaggcccctcttttaggaaagcattattatccgcacggcgtagaatacggcagcgctgaagaatttccggaacatgtcatcgctgaaagcaaagctttactgcttgaattggaagagtcattaaaaacagtgcaaatgtaataaaaaagtacagcatattctgctgtacttttttttatgagacggtatgctcgatatacggcggctctgacagcgtatctttttcccgttccgttctgacccactgaaaaaagatgacagccaaatatattccgtagaccgcctcttgaatgattttcatcagcactgccccaagctgctgatcttccagaggaggtagcgtgttaaacatctccggcccggataaagggatctcctccagcaaatctaaaggaacgcaaagcttcattgcttcggcccaagccgccggatctgtatacgtggcatacatgggcgccccgctgaacataatgagcgcgcaggccggcgttaacaaaatcccgtccgccataatataccccagcttcattaaaccgctgagacggggcagaccgtccaccttatgcacaagcggccaccacataaaaaacgccgttacaaagatgagtccgttcatcagcgtgtgatacagcgaatccgttttgacgaaatcaaatataaacgggatgtgatacagcgaaaaaataccgttaaacagcactaaagcgataagcggcattgaaaaaaatgaaaacagcggctttacgacaggacggaagatcagttttttccatgcccagccgggaattccggagatcaacagcggcggtacgactaaaaacagaaccgccatctgcgccatatgggcgctgaacatcacatggcccaataaatcgaccggacttcccgcagccgcgtaaaaaaatagcgcggaaagcacaaacagcaccttctccttaacggccacacgtcctttatgccggctgcaccagtaaaagtaaacacctgttatcacggcagttatacaaaacagatacgggctccacattgcgcgaaacccgaacatttccaaattaatcaaatctctcactccccgccgccccgattaccaccaaataatcgtgacaaatgcaagcacggtgataaacgcgacaaatattcccgaatacagaaataatgacggcgcttcatgccccttctggctcatatgcataaagtaaaacagctgaaagatgacctgaatgaccgcaagcaggatcagaaacggcatcgtaaaccatccggcaatgccgtctgcagccaccgtcaaaaacgcgacaagcgtaaggccgatcatcaagccgaaggagatgacctgatatttcatctcctcggcatttttccttctccgatattcaagatccgtactgacagtctctctgtttttgttatcgtccatcgttatcccaccatccccatcaaatatacaacggtaaagataaagacccacacgacatcgataaaatgccaatataagctggccacataatatttcggcgcattataaaggctgagccctcttttcgcattccggatcatgagcgcgctgatccacaacagcccgaacgccacgtgtgctccgtgtgtgccgacgagcgtgtaaaacgctgagccgagcgcagagcttgtaatggtaaatccgaactcgtgagtgtaatgcataaattcatagatttcaacccctaaaaatcccgctcccaataatacggtaaccagaagccacacctgcatttttttaaaggagaaatttttcatatgatacatcgcatacacactcgttaagctgctcgtcaaaagaagcatcgtcgcgataaacacgatcggcagctcaaacatctcagccgttgacggccctccggctttagattcccgtaaagcaaggaatgtcgcaaatagcgaggcgaacagaaccgtttcgccgccgagaaacagccaaaatcccaaaaacttatttttcccctccagcgttgctttttcaggagaagccggaaaggtttcagccgtcattttttcctgcagctgcattacgccttcacccctttatcatcattcggcagatcttctttgtgaatatgatagccgtaatcatcgaccacagagcgaagcagcatggtaaagaatgtgatgccgagccctatgaagataaccggaagcccccatgaataatcggagtggtataaaaacccgaacgctgccacaaacagcccgaaagatatgataaacggcatgatggagccgttcggcatatgaatgtcctctacaggctctgcaggcgccatcccttcatttccggcctgcttttcaatccacagcgggtcaagtccccggacaaacggaagctgtttaaaattatattccggcggcggcgaagagaccgcccattcaagcgtacgaccgtccagccacgggtcgttcccgacgtatttcccctttattgaggtataaataatattgacgacgagtaaagcggccgcgcctgccatgaaaaacgcgccgattgaactgatcaggttgccggtatcaagcccctggccgggcagatatgtgtaaacgcggcgcggcattcccatcaagccgagaaaatgctgaatgaagaaggtaagatgaaacccgataaaaaataagacgaacgaaattttccccatcgtttcatgaagcaccttcccgaacattttcggccaccagaaatgcacgcccgccaggatgccgaacacaacgccgccgataatgacgtagtggaaatgcgctacgacaaaatacgtatcgtggaactgataatctgccgctgcggccgccagcatgacacccgtgactcctccgagtacgaaagaaggaataaaggcgacggcatacagcataggcgtcgtgaatttgacgtttcctccccagatggtcaaaagccagttgaaaattttaatgccggtaggcaccgcgatcgccatcgtcgcaaccgcaaatatcgcattagcgatcggtccgagtcccgttgtaaacatgtggtgaacccataccatgaacccgagaaagccgatcagcacgatcgcaaagaccatagacgaataaccgaacagacgtttcctcgcaaatacgggaatgatttctgaaaaaatcccaaaggcgggaagaattaaaatgtatacttccggatgcccgaaaatccaaaacagatgctcccagattatcgtattgccgcccaattcaggattaaagaaattcgttccgaacaaacgatccagcatcatcagcgccaaaccgacggtgagcggaggaaatgcgaataaaatgagtgccgacgccacaaatgtcgtccacgtaaacagcggcagtctcatatacgttaaacccggcgccctcatattaataatcgtggcgagaaaattgatccccgcaatgagcgtacctaagcctgatatttgcaggccgagcacgaaaaagtctatgccgtgccctttcgaattcagcgcaagcgacgcgtacgacgtccagcctgcatcaggagcgccccctaaaaaccagctcagattcaaaaagatgcctccgaagaaaaacagccaaaatccgagcgcattcaaaaatgggaatgatacgtcacgcgccccgatctgcagcggcacaaccgcgttcatcagcccgaataacagcggcattgccgccaggaagatcattgtcgtgccgtgcatcgtcataatttcattaaactgctgagcacccataaaatcgttccccggcctcaagagctgaatcctgataagcatggcctcaagtccgccgacgacgaagaaaaatcccccggcgatcatatataaaatcgcgattttcttatggtcaaccgtcgtcaaataatcccaaagcaaagagctttttctttgctgtcctgtaagcgtattcatcatttgcgacctcccccctgatatctccctgtcctcacttgttctccgctttcagcccttttaaatattcatacagcgcatccgtttcagcgtccgagagcttcggataagtgcctgtcattttattgcccggtttaatgctgtccggatttttcagccaggcttttatattctctttattcgcatccttaatgccggccactttgacccgttcaccgaaggtagcgaggttcggagccgttcttgccgcttcagcccgtttatcattgggctcaaccgcatgacagctcaggcagtttttttccttaaacagctcttctccttgtgctgctaaatcggaatctgttgtatgcttataatttttcatcgctttcgtccattgtttaaattcttttgacggcagcggtttcactttgaaatccatcagcgcatgtgaaggtccgcacagctctgcgcatttcccgaagaaatattctcccgcttctttgctgcgtttagaatcgaaggtcagaaagaaagtgttgtcattatccgtattcgtatcgatttttcccccggctgacggaatccagaaagagtgtttcacatctgaggacttcagcttgaaatagacgcgttcatctgtgggaacgatcagctcctgacttgtcacaaacccgtaatcgggatactcgaattcccaccagtataaattcgcccttacattaatcacgagcgcatcctctgctttacggtttttcttatccatcggcgacgtatccgccagtgccaatgtatcgatgacaaccggaatgacaagaataatcagaagcaggatcggaataacggtccaggtgatttctaaaaaacggttcccctccacctgtttcggtatcgtgtcttcccctatacgcgaccgtctgaatctcacaatgacgtaaaagaaaataactgctacgaccgcaacgacgacaaccatgataagtgtgctgagcaccgtcagatcatattgtttatcagccacttcgccggcaggcttgagtgtggacagaaacggttttccacagccgctcaataaaagcggcactaaggctaataatgataaaagacgccaacgctttaacatttcacccaaccccttttttgaatcagtacgagatgcacaagcagtaaatctgcttccagccgaaatacttcatttcctcatttcttaaaatatgagattttttacttaaaattccatctatgtataaaagcaaagccgcctgattaaacaaaaggtcaaggcggcgtttactagttgtcattgtttgttttggcgatcaaacaagctcattattcaattaaaacagcgtgaagaccaccatcgctacaaaataaatggtcatgtagttaagcgaatagacaaacataagggttgcccacttcatgatgtttttcatgcggaatcccatcagtccgagaacaagccatccgacattcagcaaagtgccgagaatgacgatcggaagaccgagactgccgaggaaaaacggaagcggcagcaggcatgcgacccagacgataatctgtcttttcgtcacttcaaagccgtgcactaccggaagcatcggaatattcgctgctctgtaatcttccgtctttttaatcgcaagcgctaaaaagtgcggaatctgccagatgaataaaatcatgaataaaacccacgcgacaacaccgatgtgcccttcaaccgctgtccagccgattaacggcggcacggcgcctgatacacttccgacaaccgtattaatcgtataacggcgtttcgtccacattgtataaagaacaacgtacgtaaacacgccgataaaaccgatgactgctgccatcacggtggtcatcaaaagcatgataagtcctaaagcaatgagtaaaattcctgaccacagcgcttgattcggctgaatctttccggttaccgtcggtcttactttcgtgcgttccattaaatgatcaatatcacggtcgtaatagttgttaaccgcacaagaaccggcgatgatcaaagaagatcctattaatgtaagaagcacggtgtttaaattgcctaaaaaactcagaccggatatatgtaacgcaagccacatgccggtaaaagtcgtaattaaattcgaattgacgattcctattttgataagcgaaaggaaatccttccatgccgtcgtctcttcaatctgtccgtctatagctgtatcgtttaaaattctggaattagccataacgtaaacctcccttacaaacctaaagcaggttttttaagacctgcaactctatcatacaagataatgacctgtaaaaaaacatcctcttaaatattaaacgagaaacaggaatttatttgtgaactttttatgaattttaccaaatccgccggcttcataataaagcggttactttatttctatcagacccatctggaataatcaaccccattatctaagaagtcctgattctattatatttttgtgaacaaacagaattgagaattgccacaaaacacatattcgcttacacttggtacgtatatcattttgtccagtttgttaagaaggtgaatgtaaaatgaataaagctttgaaagcgctcggcgtgctgacgacgttcgttatgctcgtcgtgctgatcggcggcgctcttgtcacaaaaacaggatcgggtctcggatgcggaaggcagtggccgctttgccacggccggtttttcccggagcttaacgccgcttctatcattgaatggagccacagactcgcaagcggtgtctcaatcgttctcgtgctgagtctcgctttttgggcatggagaaaagtcacgcctgttttccgtgaaacaacctttctcgccattatgtccattatctttttatttttacaggcgcttctcggcgcattagcggttgttttcggatcaaatgcgctcgttatggcgcttcatttcggcatatcgctgatttctttcgcttctgttctgattttgacgctgctcatatttgaagctgataaatcagacaaaaagctcgtcaagccgctcagaatcggcaggaaaatgcagtttcatatgatcggcctttcgatttacacgtatatcgtcgtttatacgggggcttatgtgcgccatacaaaatcaagccttgcctgtcctgacgttccgctttgcagcagactgaaccacggacttccgtctcattttcaggagtgggtgcagatgggccacagaacggcagcgctgcttctgttcgtatggattcttgtcgcttttgcgcatgcggtgcgctcctacaaagaccaaaaacagattcttgggggctggatagcggctcttgcctttgttgtattacaggcgctctccggaatcatggttgtttattcagaaatggccaccggctttgcacttgcccattcgctctttattgccggtctgttcggtgtcttatgctatttcttattattaatcgcccgcttccgctatgaatcaaaacagcggaacatctgaggcacatgaaaaggccgaagcatcaaagcttcggccttttcacatataaaaaacctgatcgcacacggggcggatcaggttttttatgtttattttttacgctttttcaatttcgatcagtaaatcgcctgtctgaatcggttcaccgtttttcacatgaatctgctgtattgtcccggagaacggcgcctgtaccgtcgtctccattttcatcgcttcattaatcatcagatgatcgcctttattcacctttgccccggtttccgttaacaatttaataaccgttcccggcatggatgccgcaatgtggcttgggtttgtccgatctgcttttaatttttcctgtacggacgatttaatgctttcatctttaatgaccacttcgcgcggctggccgttcaattcgaaataaacgacacgtgtcgcatctggctgcggttcaccgatagatacaagcttcacgatcagcgtttttccgcgctcgatttccacttcgatttcttcaccgagtgtcatgccgtagaagaaagtcggtgtgtccaatacggaaatatcaccgaagcgttcagccgttttaacatattcagtaaatactttcggataaagagcatacgcgattgcgtcctgatcactcaattccatctgatgcgtttctttccattcttctttaatgccttcaaaagataccggttcaagcagctcacccggtcttaccgtgatcggcgtctgtcctttcagaacgagcttttgcagtttttccggaaatccgccgtgcggctgaccgatctgccctttaaagagctcaacgactgaatccggaaaatcaagcgtttcgcctttatcataaacatcttgttctgttaaattgttttgcaccatgtaaagcgccatatctccgacgactttggaagaaggtgttactttcacgacgtcgccgaacatgcggttgacaacgctgtacatgtctttcacctcattccagcgatcgcccaggccgactccttttgcctgctgctgcagattgctgtactgcccgcccggcatttcatgattataaatctcagtatgcggagacttcatcccgctttcaaattcactgtaatactgacggacggattcccaatattgtgacagtctttccacctgccggacatccatttcaggacggcggctgtttccttcaagcgcatgataaaatccgcttgcgctcggctgtgaagtcagacccgccattgagctgacggcgacatccacgatgtccacacccgcttcaacagctttggcatagagaaagacgccattgccgctcgtatcatgcgtatgaagatgaacgggaatatcaatcgtttccttcagcgctgagacaagttcgtatgcggcttgaggtttcaaaagaccggccatgtctttaatgccgagaatgtgcgcaccagacgcctcaagctctttcgccatagaaagataatattgcaaatcatatttcgtccgggtcttatcaagaatatctcccgtgtaacaaatcgcagcctccgccacttttccggtttcacggacggcatcgatggccagcgtcatcccttttacccagttcaggctgtcaaagatccggaatacgtcgataccggactccgctgactgccggacaaatttttgaatgacattgtcgggatagtttgtataaccgacggcatttgatgaacgaaggagcatctggaacaatgtgttcggcacttccttacggagatcttcaaggcgtttccaagggtcttcttttaagaaacggtacgctacatcaaatgtcgcgcctccccacatttcaaggctgaacagttcaggccacagggcagccgtaggattcgcgatttttttcaaatcgttggacctgatccgtgttgcgagcagggactgatgggcatccctgaacgttgtatcggtcaggagcacggatttttgctctttcacccagtctgcaagtccctcggcgcctctttcatcaagaatctgtttcgtaccgcttgccggcttttccccgatatctaacgtaacggtctgaggcttatcaaatgcaggtttttcttttttcccgattcccggaaaaccgttcaccgtgacattgccgatataggaaagcatttttgttccgcggtccttctgttttgggaaaacaaacagctcaggcgttgtgtcgataaacgatgtgtcgtattggcccgtcaggaatttttcatgctttgccacgttttcaagaaacggaatattggtcttaatgcccctgatcctgaattcctgcaggttgcggaccattttcgctgatgcctgttcaaacgtcagcgcccatgtcgacagcttgacgagcagtgaatcataataaggtgtgatgacggcgccctggaagctgtttcccgtatcaaggcggacgccgaaaccgccgcctgagcggtaagccataattttacccgtgtcaggcataaagtcattcagcggatcttcagtggtcacacgtgattgtatcgcatacccgtttgtaaaaatgtctttctgctctgggatattgacggcgcggctgtgcagtccgtggccctgcgcgacgagaatctgcgtctgaacgatatcaacccccgttatcatttccgtaatcgtatgctccacttgtacgcgcgggttcacttcaataaagtaaaattcaccgcccgctacgagaaattccacggtccccgcgttgatatagccgacatttttcgcaagcgccacagccgcttcacagatttcgtcccttaattcaggctgcaaagatacactcggcgccacttcaatgaccttttgatggcgtctctgaacggaacagtcccgctcatacagatggacgacattgccttctttatctccgatcacctgaacttcaatatgcttaggattttcgatcagtttttcaacatacacttcatcatttccgaatgcggctttcgcttctgatttggcccgctcaaacgattctttcaattcgctttcgcttcggacgattctcatgccgcggcctccgcctccgagcgatgctttaataataaacggaaatccgtggacttttgcgaattgttcgacatcttttaatgtttcagccggtccgtcactccccggaataacggggataccggctttttccgcctgctccctcgcctttaccttatctccgaacatatccaaatgcgctgacgtcggtccgatgaatacgatgtcctcttcttcacagcgtctcgcaaattggatattttcagagagaaatccgtagcccggatgaatggcatcaacgccgtttctttttgcgatctcaataatcccttcaatatcaagatacgcgtcaatcggttttttgccttcgcccacaagataagcttcatccgctttatagcgatgataggagcccgaatcttcttttgaataaacggctaccgttctgatgttcaattctgtgcacgcccggaaaatccggatcgcaatttctcccctgtttgctactaacactttttggatggattgttgtgacaaacttttctcccccttggcctaataaatatgtagtttataataaaggaatatccgccctgtgtatacacttgttttttagagatacacagatttttccgtctgccgtctttttacccctttagacggaacgggctccctctttttcttcttttctgagtacttgacatgcatgctgacattcaccaatataccggcgctcgtcaataacaaaaacattgatgatcccccgtagctgataaacggcagcggaacacctgtgatcggaattaaaccgctgacaccgccgagattgataaaggtctgaatcgcaatcatgctggatatcccgattgccaaaaggcttccgaacggatcttcacattttctcgcaatataaaaaccttttaacaccacaaaagccagcagcacaatgacaaacaggacgccgaaaatgccgagctcctctgaaataaccgccataataaagtctgtatgcgattcaggcagataaccgtatttttgaatgctttctccaagaccgagaccgaaaaaaccgcctgagccgatcgcataatacgaatttataatctgcagacctgatgtgctggcgtatttaaatggattttcaaggctttcaaaccggctcatacgcccgggtgtcaaaatatcgtcccatttcagataaatgatcgggctgacaaggagtaatacgattcccgccatgagaaccagcctgagcagggtccttccgctgaatcccgaacacataatgacgcaaaacgcgatcagaccgataatcatcgccgttccgaagtcgggctgaatagcgataagcgcacaaatgactacggtgacgatcaccggcggcgcaacccccgtcaaaagctgatcgatgtagctttgtttctttgcgtacaccgcggcaagatacagtatcagggtcagcttgacaaattcccccggctgaatggccattccgccgattttaaaccagctttgcgcatttccggcaacatgtccgaaaacaaacagcgcgcaaagcgcagccactgacgcaagcagtatgattttctgaatcttttgatgggcgaacactttgtacggaaaaacggccgcgataataaacagcacaaaccccgcgatgacggcgaacagctgccgtttaaagaaatagtcgctgctcacgccgtaacgcataacggcggtaatcatgcttgagctgtataccattaccaatccgaaactgcacagcagaatgatagcgcatatcaatgaataatcgtaagattttaacattcttttaaacataacatcctctttcctgcttaaagcttacgtttaatacctattgcgtattatattttactataattcataaacaatttacgcagtttctttatagtttttcggatgaaatgcagattaagagaccgtcttacgaaaagaagatgcaaaaaaacggtttacggttataaaaaaacccaaaccgttgaatagtttgagtttgatcatttattttcctgtaaacgcgtcatgcaaagcagacagttctctttcaagtctgtccagcagctctttgccgtcgttttcgtcaactaatcccaggcggacagcaaaatcgatttccctcgacagtccgaacatctgagtatccaagacctcttcatacagaggacattgaggcatcgttaagttatccatttgtactcggatcagcttcaaaatcttctcagcatctaacttcaacagctcgaatgctttctgctgatggtcaactataatctctgaagccaaaagtatccctccgttccccaggcgagtacctaattcttctatttatcataaagggtatcagatgaaattgcaagaggatttaagcagatgttatgataaaaaatgtttcaaaaaatactcagcctgtatttctcagacatgatttccaaaagcttcacacccgcgatgctgttgcctttttcatcaagcgccgggccgaatataccgattccgaagttgtacggcgaaatgcccatgattcctcccgaaacgccgcttttagcgggaatgccgaccttgattgcgaattccccgctcgcattgtacatgccgcatgtcaccataaacgtcttgcagattctcgccacatcttttttaatgacctgctccccggtttccggatgcttgccgtcaagggcgaatacacagccgattttggctaaatccagactgctcatcttaatcgcgcactgttttgtatacaaatccatgacctcttcaacatcgcctttaaaaatgtcatactgcttcatgtaataacacatggcccgattaatcatggaagatttgaattccgattccgcgacatgtctgcaatatgtaatgtcctgattgttcgcaagtcttctgatgaatccgagcaggtaatccaggcggtctttcggcgaatgccctttaattaaacccgtaacgatgagagctcccgcattaatcatcggatttaaaggcttgcccggattcactgtttcaagcttaatcatggagttaaacgggtcgccggtcggctcctgacccacgcagctgaacaccttttcctttccgtaatccatcagtacgagcgccagagaaagcactttcgaaatgctctgcagcgtaaatgtccggtcggcgtctcctgccgtcagacatgtattttccgcatgataaatcgtgaccgaaaggctgtcttgttcagattcagccagagccggaatatagtctgccactttgccttctccggttctttttttcgcttcctgaactaatgcgtccagctcttggtaatgccggcataccatgtcgatcatcctcacttcgctgccgttgtatacatctaatttgcaacgcaaagtgacaattcatgcgaaaacttttatactttaagtaaaggggggcttcaacatgagcgttattcaagtaaaaggcaatgttacatacccgattacaattgatccgagtgtctggattttcgatgaccgcaaatttccgtttgaaaacaatcagcctgttcatcaggacggctctgcagaaacccaggagcatacgcttgatcctgaacgggtgatcagagaagggcgcatttcgccgccgactttaaaaagtgaaaaacgttatgaaaaagaaagactgatgaacggcagcttcgccatgaagctcggcgctgttttagcaaatgccgagccgaaagaaagcgctgtcctgtgcgcatttatttcaaaatcagaaagaaccgaagtgccgcttgaaaaggcgatggacgcaatcgcgcatttcagcgatgcggggaaaccgcttcaagacggcggtccggtccatttttacgtggacggagactttgaaaaaccgataacgggcgtcacagaaatcgaagttttataacaaatcggcggcaagctgtgcaaggccggatctctcacctttcacaagcttcacgctgccggagacggtttgtcctttaaaccgctctacaacataagcaagtccgttgtttaaactgtctaagtatgggtgatctatttgctccggatcgcccatcaggacaattttgctgccctctcccacccttgtcaaaagcgttttgacctcgtgcctcgtcagattctgagcctcatctataataataaactgatccggaatgcttcttccccgaatgtatgtcagcgcctccacctgaatcgatccgattcctgccaaaatcgcttcaagttcacccggctttttcgcattgaataaaaattcaagattatcaaagatcggctgcatccacggcttgagcttttcctctttttcgcccggcaaatatccgatatcctttcccaccgggacgatgggacgcgcgacgatcagctttttataaataccgagatcctccgtctgcagaagccctgccgcgagagcaagcaaggtttttcccgttcccgcttttccgatcagggtgacaagcgggatatcttccctcagcaggagttcgagcgccattgtctgctggacgttcttcggcctgatcccccatacgtgctcatcatcgaaaacgagtctttttacggtctctcctttcttatccgccatgccgaccgcagacgaagatcctcctaattcatctttcatcagcacaaattgattcggataaacctgatgctgctgaagctccttgactggaatttgtttgtttttataaaacgaggcaaaccgctctttattcataaatatatctttgtacccgctatatatttcatgatggtcaacgactctgtcgtttaaaaagtcctccgccaaaagcccgatggcatccgcctttaccctgacaagcacatctttgctgaccaggatgacgaggcggccgttttctttcgtttcctcctcaaggcttaaattttttgccaccgccaaaatgcggttatcattcgttttttcgataaaaatttcttggagctgatgaaatgaccggtggttcagttcaattctgagcgttcctccgctttgaagcggaactttctcgtgcagccttcctttctccctgagcccgtctatcagcttagatacgtgcctcgcatttctcccgacctcgtccatataccgcttttttgaatcgacctcttccagcacgacggcggggatgacaacttcgttttcttcaaaggaaaaaatggcgttaggatcctgcaaaagtacattcgtatctaacacataaattttactcaagtctcagcctcctgaaataaggatcaaagcccatcgtgtgcttctctttccgcgaaaaacggggatgcctgctaaaatatatgatttggtgaataaagatagaaggttaattcaacaataaaataaatgaaagcattcaaggagggaatctgacgtgcgaattcttttcattatcatacaagccttgtttatcctgaccggctgcactgctgtacaggacggccgcggccgcaatatccagaacgaatcaaccgatcagcgtgatgcaaaaccgattcatgtaaaaaatacggctcctgagacagctgaaaatcccggccggacagacatcgctaagcatctcgtcgaggtaaccgaaaaaatccccggcatttcagatgccaccgcggttgtactcggaagatactccgttgtcggaatcgatgtggatgacaatttagaaagaagcaaagtggagagcattaaatacacggtcgcccaggcgttaaaaaacgatccttacggcgccaatgccgttgtcgtggctgatcctgatacggtttcccgtctgagaggcatgggcagcgacattaaagccggccgccccgtttcaggcattttggacgaacttgccgccatcgtcggtcgtgtcatgccggaagtcccgaatgatgtgaccgacaatgaaaaagaatcaccgactcaatcgaatgatgatcagctgaaccaaagagaccagaacaagctgcagaacgaacagaacgatcaatcggatcatcatatgaaaaaccgccagtaaaaagcagcgcccgctccaaaagaagggcgctgctttctttccctttggcaggaggggcatccatgatataatgcttgtcatagtgaaagaggtgaaaatcaatgagagtaaaatgttccatttgcgacaaaattgaacaaattgatgatgaaacactgacagccaaacgcctccgcaatcgtccgattcatacatatatgtgccgggaatgccatgaccgaatcaaaatcaaaacggaggcgcggctgaataccggacacttttcctttcatcctggacaaaaagcgaaaaaagataaactgaaaaaataaaccgcaataaaaaatgacccgccggaaggcaaggtcatttttttattgcggtttagctgactggctttttttggactggtgcagacggattttgtaaatgatcaaaatcaaggcggcgacaacaagcccttctccgaccggcaaaaacacaccgaaaaaagtcagcacggtgcagccgagcacgagaaagagataaactgccgcagccttcaaaaccggcagccgtttggcaaagccgagtttaaatacaatcaccgaaagcacgacgatcgttccgtataacagccacattcccgccagcggatgctcatccacttggtaaagagccgcaaagaacgacagccgttcacttacttcattcaaaaagatccccctccccttttccgttcgggttctaccttttcaaattctgcaagtgattaagacattcctgctgtttttttctttttcgccgctttttcacgttcgtttttattcaggattttctttcttaaacggatggattccggcgttacttcgcagtattcatcctcgtttaagtactcgagtgattcttcaagcgacataatgcgcgctttcttaatcgtagtcgtttgatccttcgtagcggaacgtacgtttgtctgctgtttcattttgctgacattgacaacaaggtcattgtcacggttatgttcgccgacaatcatgccttcatacacttctgttccgggctcaacgaagatgacgccgcggtcttcaataccttgaattccgtaagatgtcgcttttccgttttccatggaaacgagcacaccctgacgtcggcctccgacttggcctttttgcatcggctgatagctgtcaaacgtgtggttcaggataccgaaaccgcgtgtcagtgacagaaactcagtagaatagccgatgagtccgcgtgaaggtacggtaaagatcaggcggacctggccgtttccgttattaatcatatcaagcatttcgccttttctcgcacccattgattccataacagaaccggtatgctcttcaggcacgtcaatctgcacgcgctcaacaggctcgcagctgacgccgtcaatttccttaatgataacttcaggtttagacacttgaagctcatagccttcacggcgcatgttttcaattaaaatggacaggtgaagctcaccgcgtcctgaaacaacccatgcgtctggtgatgcagtcggttcgacacgaagactgacgtcagtttgaagctgcgcattcagacgctcttcaattttgcgggctgtgacatatttgccttcacggcctgcaaacgggctgttgtttacgacaaatgtcatttgaagcgtaggctcatcaatgcgcagaaccggcagcggctcatggtggtcagccggacaaaccgtttcaccgacgttgatgtcttccatgcccgaaacggcaacaaggtctcccgctctcgcttcttcaatttccacgcgtttcaatccttggaaaccgaagattttcgttacacggaatgatttaaccgttccgtcaagtttcatcaatgaaacctgctgacccactttcatcgttccgcggaaaacgcgtccgataccgatacggccgacataatcattgtaatcaagcagcgccacttggaattgaagaggctcttcggcgttatctaccggggcagggacatgttcaagaatcgtttcatacagtgattccatgttttcgtcctgctttttcggatccagacttgccgttccgttaatcgcagaagcgtagacgacagggaactcaagctgttcttcgtttgcgtcaagctcgatgaacaaatcaagcacttcatcaatgacttcttccgggcgggcgaaatcacggtcgattttgtttacgacgacaaccggatttaagttctgctcaagggcttttttcagtacgaaacgggtttgcggcatgcagccttcataagcgtcaacgactaacagaacgccgtcaaccattttcataatccgttctacctctccgccgaagtcggcgtgtcccggagtgtccaaaatattaatgcgtgtatctttatagttaatcgcagtatttttcgcaagaattgtaataccgcgttcacgttcaagatcgtttgaatccattgcgcgttcggcaatattttcgttggcacggaatgttccggcttggtgaagcaattggtctaccaaagtcgttttcccatggtcaacgtgggcaataatcgcgatgttgcgaagatcgtttcgaagtttcacattttcatctcctaaaaaaattagataactttcatattataccacacatcctctttaaaagcgttacgtttttctgtaaactgaaagtatgacgttaaaggggatggaaatatgaaaaaattgaattggctcttattattatttgcattcgcagcagtcttcagcatgatgctgatcggcgtatcaatcgctgagaaaagcgcatggggcatcatcggaagcattgttctcgttatcgccatgatgggaagcggtttcaccgtaaagaaaaaaatgcgcgaacagggactgcttgattaaaagcatgaccctttgcaaaattccgtaaacatggaaagacaatatcttatgaagcctgaatcaaagattcaggcttttttacctcctcaaaaacagactccagatgtaaggcttatctcccccgccgtctagtcaggaagccgggaatgacggcccccattctagttacatcagcagattccctcagaatatacagtctgaaatagtccggcatcgttatgcagaaaataccatacctcctatatcaattccatcattgtctttttatacttgtgactgtaagcaaatacacatgacaaggagagaatgaaatgaaaacatcttttttgaagaaaaccgctgtaactgccgccgcaaccgcctcagccgccttgcttgcattcagtccgcttgattctgccggcgcaaaaacgatccaggcaaatgaaccgcataccctgcaggtttccgcagagaaaacaccggaagacgcggcaaaactcattgacatcatcagccaatcgatttacgaaaaagacggcgtctattattttgacggtgaaaaagcggttgaattgggattagataaagaagccgcacagaccattcaaaagctgtgggacagttcaaccgaatttttaaccgttctttctcaatgtattgagaaaacggacggcgaatatacatttaataaagaaaaagcggtggagctcggatttacggaaaaagaggcccttatcgttgatcagctgttcaccactttttcccaaagtcttcatatccttcaatctgcgctgattgaagaagacggtgtgtatacgtttgatcaggaccttgctgaaaaagcaggagcaggaaaaaaagaagcaaagctgtgtgccggattctttaattcactgcctcaggacttgcttgaaggcatttatacagcctttcatccggctgagtaaacggataaaacgcccggtcatgtcatgcagccgggcgttttttttaatcagcagtttaaagatcagcatgataaagaaaacagcgccgaacaaacaggctgcttttatcagcagcttcccgtaataccgttccttaaaccgcctttcttcttctgcataacaggcgggctccttcatctcggggctgccgaggtcaagcggctccttcatcatatgatataaactttcgcacttaccgcatgattcaaggtggcgggaaataaaccgctccgtttctgtttcacaatcgccttcaatatatatagggagtaaatctctcactaaacagcaagtcatatctgtccgtccttccttttttccgctaagtgctgtttcagctgcattctcgccctgtacagagtgctcttcaccttcgaaagactccagtccaaaacatcagcaatctcttcgtaagacagctcttgaaatatctgtcgaaatgctgaataaaatgactgaaaatctctgacatctgaaacaatccttttcgtttattaaggcctcacctgtttagacaaacggctataaaaaaagttttacagatcggaacatttttcctctattatttctcccgacttcatttgtcatttttttcagaataaatcgcatcattcgactcatgtttgattcaacacgtgcctctcggcttatcccctgacgctgcccgcctgaagcctttacgggacgattctatcaattcatcagcgaagtctagttttatattgcagaatgagagaatgctggtttattataacaatataagttttcattattttcaaaaagggggatttattgtgggtttaggtaagaaattgtctgttgctgtcgccgcttcctttatgagtttaaccatcagtcttccgggtgttcaggccgctgagaatcctcagcttaaagaaaacctgacgaactttgtgccgaagcattctttggtgcaatctgaattgccttcagtcagtgacaaagcaatcaagcaatacttgaaacaaaacggcaaagtcttcaaaggcaacccttctgagagactgaagctgattgaccacacgaccgatgatctcggctataagcacttccgttatgtgcctgtcgttaacggtgtgcctgtgaaagactcgcaagtcattattcacgtcgataaatccaacaatgtctatgcgattaacggtgaattaaacaacgatgcttctgccaaaacggcaaacagcaaaaaattatctgcaaatcaggcgctggatcatgcttttaaagcaatcggcaaatcacctgaagccgtctccaacggcaacgttgcaaacaaaaacaaagccgagctgaaagcagcggccacaaaagacggtaaataccgactcgcctatgatgtaaccatccgctacatcgaaccggaaccagctaactgggaagtaaccgttgatgcggaaacagggaaagtcctgaaaaagcaaaacaaagtggagcatgccgctgcaaccggaacaggtacgactcttaaaggaaaaacggtctcattaaatatttcttctgaaaacggcaaatatgtaatgcgtgatctttcgaagcctaccggaacacaaattattacgtacgatctgcaaaaccgacaatataacctgccgggcacgctcgtatcaagcactacaaaccagttcacaacttcttctcagcgcgctgcggttgatgcgcattacaatctcggcaaagtgtatgattatttctatcagacgtttaaacgcaacagctacgacaatagaggcggcaaaatcgtatcttccgttcattacggcagcagatacaataacgcggcctggatcggcgaccaaatgatttacggtgacggtgacggctcattcttctcgcctctttccggttcaatggacgtaacggcccatgaaatgacacacggcgttacacaggaaacagccaacctgaactatgaaaatcagccgggcgctttaaacgaatccttctccgatgtattcgggtacttcaccgatactgaggactgggatatcggtgaggatattacggtcagccagccggctctccgcagcttatccaatccgacaaaatacggacagcccgaccattacaaaaattatcaaaaccttccgaacactgatgccggcgactacggcggcgtgcatacaaacagcggaattccgaacaaagccgcttacaacacgattacaaaaatcggagtgaaaaaagcggagcagatttactatcgcgcactgacggtatatctcactccgtcatcaagctttaaagatgcaaaagcagctttgattcaatcagcgcgggacctttacggctctcaagacgctgcaagcgtagaagcggcctggaatgcggtcggcttgtaaacaagaaaagagaccggagaaatccggtctcttttttatatctgaacatttcacaatggcttcaccatgatcatatatgtcttttcccgatcgtctttttcaagcttaagctgttcaaagccgcattggcttaaaaacaaaacccattcctgcctgtccaggggaacggctgaaaacatcgctttatgctctcctctcagccggcccgcaatctcttcaatgaccgcgcgaccgattcctttctcttttgcctccggagcgacggccacggttccgagccacggttttccgtttgaaggcgcccattccaaatgaaaactgacggcggcaggagcgccgtcaatctcccatacgagccacgttccattgtacatggagtatgcaagcataaactccgccgcattttttgttccgaactcttcgtttttccacaccgggtgtgatgccgccagctgctccagaaacccgagatcttcttcttcaaaatctctacctgtcagcatgtaaatagtcgtcaaagataattttatgtatagccggattgcccgcaagcacgctgtggttgtctaaaaacgtgaacggttcgccgtctgtggtcgtgtaaatgcccccgacttcgttcagcagcacgcagccggcagcgtaatcccacggcgcgagcctcatcgtaatgtatgcgtcaatgcggccggccgcaacaccggccagctcaagtgccgccgaaccgtaggaacgcgttcctctgacccgttttacgagcggcgccaaaatactcgggtcaatccttctgttttccgtcacccatgtggcattgattgcaataatggcttcttcaatggaagcttcttttaaaggagcaagcggcgtatcattcagataagccccttttccgctgaatgcgtgatacagttcgtcctgcatcacatcataaattaagccgattttgccttttccgtcttcaaagatgccgatggagatcgcgaaatgccgcttttgatggacaaaattcatcgtcccgtcaatcggatcaatgatccagacgattccgtcaagggagcggagtttatccccctgcccttcttctccgagaatccggtgtccgggaaaagttccttgtatacggtcaatgaaaaagcgctccgtctctttatcaatatttgtgactaaatcattcggatttgattttgtttcaatcgtcaagctttcctgcatggattgtctgattctcgttccggcttcttttacccattgttttgcgatatcatcaatttccgtccaatttgtcataccgtgtacctcttttctatgtatagcttattctatagcatactgataaaggcgatgaaaaagcaaggaaaatgaaaaaaatgccttctcacgtaaaaacgaaccatttcctgcggttcgtttttactattctttatccgttaagccgaatccattcttttctgagacgttccagttttcttttgctgagatcgatttgatcttcattctctttttgcatggcctcgtacagggttgccaattcataatcaacctctagtctccagacagctacacggttatttttttcctccctgaatccttccttcaccacttgcctcattgtctttcgccccttccagagatcatttgttaaaaaagcatcccatttttccaattcattaatgatacttcttatatcgtatggaaacttatattcggctgtaacaacattcttaaaattgtgtgtttacctattcgttttttaccaccattcctctcgactcaaacgttctcaatgtttttgcggcgggcggcggctgtggtaaaatatgaatacttacgttaaggaggaaaaagatgactcagatgcgttttacaaaagaagacttcgatacatttacaatagaaggtttagatccgcgcatggaggtgttaaaagaacaagtccgtccgaagctgaccttgttaggagagcatttcgcaccgacattgtcagcattgacaggagatgaaatgttcccgcatgtcgccaagcacgcgagaagatctgtcaacccgccggctgacagctgggttgcctttgccaacagcaaacgcggctataagaaactccctcactttcagatcggtttatgggacacccatatgtttgtatggtttgccatcatttatgaatctccgataaaagaggaatacggcagattgctggaagcgaagcaggaggaaatcacaaaacagattcccggtcattttgtatggtcgccggatcatacgaagccaggtgcgtacaagcagtccgacatggatcaggagcagctgaaaacattatttgaacgcctgcagacagtgaaaaaagcagagcttttatgcggcattcagctgcaaaaagaagacgtgatcaacatgaacaacaatgaattcctgcaaaccattgaagatgcttttaggaagctttcctttttatacacactgactcagaaagtctcataacataaaaagcgggccgattgccggctcgcttttgtctacattttgataatcgcttgatctgattgtttcgcctgtttcacagtccgatacggggaataggtgctgtcagcttcaaattggctgcagattttcttttcttccgctttcccgggaacgatttctttaaagcggcggtacgcattcagaagtctgtctcggtcagctcctttttcataggcgttttccacctgctgaaaaaaagcaatgacatccacggcctcctctgtcgtccagtcctcattcatcggatattgatattccaaatgtcttcactcctttatcatcatgctcaaaaataagcatcttccatagatcataaattgttctttactttctttcaagttcataatataattcatttgttttacgtttaaaaaacgggtaataaaactgaatgtaatacaaactaatccgtaggtattatgataaaggtgggaaaacaattgccgcaacatgaaacacccctgtacagcggactgaaaaagcacgcggacagacagcctgtccaattccacattccgggccataaaaaaggcgcgggaatggatccggaattcagacaatttatcggagaaaacgcgttaagcatagatttaattaatattgaacccctggatgatttacatgcgccaaagggcatcattaaagaagcccaggatctggccgcggaagcattcggcgcagaccataccttcttttccgtacaagggacgagcggcgccattatgacgatggtcatggccgtatgcggacccggagataaaatcatcattccgagaaacgttcataaatccattatgtcggccattgtattttccggagcggtgccgatttttatacacccggaaattgacgatgagctcggaatttctcacggcattacgcttgagtccgccgagcgggctttgacggaacaccctgacgcaaaaggcctgcttgtcatcaatccgacatacttcggtgtggcagctgacttgagcagcattgtaaagctcgcgcattctttcgatgtgcctgttcttgtcgatgaagcgcacggcgtgcatattcattttcatgataagcttcctctgtccgccatgcaggcgggcgctgatatggcagccacaagcgtgcacaaattgggaggctccctgacgcagagctccattttaaatgtgagagaaggccttgtttccaaagaaagagtacagtcgattttaagcatgctgacgacaacgtcaacatcctatctgcttctcgcttcactggatgtcgcaagaaaacgcctcgctacagaaggccgcgatcttcttgaagatacgattctgctggcggatcagacacgggaacgcctcaatcaaattgaaggcatccgctgtgtcggcgaagaaatcactgggtcaaaagctgccttcagttatgatccgactaaattaatcatttcggtcaaaaacctcggcctgacgggtcatgacgttgaaaaatggctccgcgaatcatttaatatcgaagtcgagctgtccgatttgtataatattttatgtattttcacccccggagacagagcaggagatgccgaccgtcttgtaagcgcgcttacagacatttcaaagcaggcttccgcaaatgattatgctcatcagcaaacggaagttctgcttcctgagattcctctgttagcgatgacgccaagagacgcgttttacgcaaatacggaagtcattccgttaacagaatccgcgggacggatcattgcagagtttgtcatggtgtacccgccgggaattccgatctttattccgggtgagatcattactgaagaaaatatcagctacatttttaaaaacttggacgccggccttcctgtgcagggtcccgaagatgccacgcttgaaatgatcagagtcatcaaagagcaaaaagccatccaataaacataaagaagcccgaaacgaaatcgtttcgggccttttttacgctttttactcttcttcaagatgacactggcattgtccgcagcatgttccgtataacgtcgtgaccttctcatcctcaaagtaatgaatcgcttcgttacagtcttggcaaacaattgtacccatctgtcattccccatttctcagaatttgaaaacgcttaatttttacttgttgttattatattattatgtcacatttaatatgtcaactgataaattgtataacacatttattttttacggtctttttatagctcgagggttaatcacggtatatcctttatgacgcaatccttttacaatgtccggcatggcttcagccgtccatttccggtcatgcatcaatatgttggcgccgtcccgcaggtaaggactgctcagtgtgatatcggtaagcgcttttttggattgatatttctgatcccaatcatacccgaaggtccagttcattttcaccataccttctttttttataagtctgtcactgtagtccgtattgcttccgaaaggcgccctgaaaaatgcgggtttctctcctattaccttttcaaccgctttattgacgccaatgatttcttcccgttgtttttgttcggaaagatcttttaagttttgatgagtcattgtatgatttccgatcataaaacctaactcatgaatatgcttaagcgctttcttattttcatcttttttcaaaaaatgtccgtttacaaaaaagatcgctgacgcattgagatcatgcagtttgtccgcaatctcagcggcatgctgatcaggcgcgtcatcgatcgttaccaatgcgatcggttttttctctttctgttcatccattttttccacagaaaaggttttcggattgatatagtaacggggctccgccttctgttttttctcttttgtatgatggttttcccgtttggcatgattggccgcggcttgagaatggggtttgtttgtttgcatcttttcatttgattggcagccggcgagtaagcacatacatatgacggctgcaatggctttatacatgcaatccctcctgatatggttttgcccccagtataacgaaaaaacagcgctctcacgaaaaacaatgtgccttttttacacatcggctgtgcaagttgtcacacgtattatttcttcattaaaaacggtttcaattatataacaattcagtaacaagccttaggtttttcacctctcgtgatacacttaatatagtccttataaatggatgaaccaatatattatataaaacagaggagtaagatagatgcgctaccgtacggtgattcccttttttttgatgctgttcgttctgtcaagctgttcggtttctactgtcattccattcaaaaataaccggatcgacagcattcatcacactcaaatcttgtttttttccgatgaaaatcatatagataaagaagttccttattacgatgcgattcttgatttagaaaagaaatatccccatcatgtcgatcaaatgaaggtttatgacaacagaaagggatgggaagaggaaatcaacacgttccctgcgctgatggtgatcaatcatcggcatgtggtcatgaagattgagggatccgtaaagaaaaaagaggatatcatcaaacctatgcagcatgtgcttgcacaataaaaacagcccccgcttttacaaacgggggctgtttctttgttacatcattattttacgatgtggatcgggcttccgattgctacttcggcagcttccatagtgatttcgcccaatgtcgggtgagcgtgaattgtcattgcgatatcttcagcagtcattccgccttcgatcgccaggctcaattcagaaatcatgtcagaagcgcttgcgccggcaatttgcgcaccgattacaagaccgtcttctttacgggtgatcagcttcatgaagccgtcagtttcgttaagagacagcgcacgtccgtttgctgcaaacgggaacttagctgcaacgacttcaatgccttcttctttcgcctgtgcttcagtgtaaccgacagaagccagttcaggctcagagaatacaaccgccggaataccgaggtaatcgatttcagccggctctcctgaaatagcttccgcagcgattttaccttcgtaagacgctttgtgagccaaaggaggtccgtcaatgatgtcaccgattgcgtaaatgttcggtacgtttgtgcggcactgcttgtctgttttaatgacaccgcggtcagtcatttcgataccgacttgctcaaggccgagctcatcagtgttcggacggcgtccgacagtgattaatacgtaatcagcatcaaccgttttttcttcgccttttacttcgaatgtaactgttacgccgtcaggtctttcctcaacgcctttagccatggcgcttgtatggatttcaacgttgccttttttcttcagtctgcgggtaacgagagaactcatttgtttttcgaagccaggaagaatttcatctccgccttctaaaataaccaattcagttccgaagttcgcatacgctgttccaagctcagtaccgatatatccgccgccgataacaacgagctttttcggaatttctttaagcgccagtgcgcctgtagagttcagaacgcgttcgctatatttgaagtttggcaattcgataggacgagaaccggtagcaatgatcgcgtttttaaatgtgtatgtttgcgcagagttctcatccattacgcggacagagttgctgtctacgaaataagcttccccgtttacaacgtccactttatttccttttaaaagacctgcaacaccgccggtaagcttatttacaacagaagctttccattcttggacttttgtaaagtcaaccgttacgttctcagcagtgattcccatgtcatctgaatgttttgcattctcgtaacgatggcctgcattgatgagcgcttttgaaggaatacagccgacgttcagacaaacgcctccaagagttgctttttcaacgactgttactttttgtccaagctgagcagcgcggatggcagctacatagccgccgggtcccgcaccaatcacaagagtatctgtttcaatagggaaatctcctactaccataacattacgcctccattaaaataagttgtggatcgttcagtaaacgcttgatgtggtttaacgcattttgtgcagttgctccgtcaatcatacggtggtcaaagctgagagaaagagctaagacaggagcagctacaatttcaccgtcacggacgatcgctttttcagcaatacggccgataccgagaatcgcaacctctgggtggttgataaccggtgtgaaccattggcctccggcagaaccgatatttgtgatcgtgcaagaagcgcctttcatttccgcaggtgcaagcttgccttcacgcgcttttgtagcaaggctgttgatttcatcagagatttcgaaaacggctttacggtcggcatttttcactaccggcacaagcaggcctttttcggtatccgctgcaattccgatgttgaagtaatgtttttggatcacttcatctgttttatcatcaatcgatgtgtttaaaacagggaattttttcaaagcggatgttaatgctttgacgacgtaaggcagataagtcagcttgatgccttgatcagcagcaacttgtttgaactgtttacggtgagcaacaagatttgttacgtcaacttcatccataagagttacgtgcggtgcagtatgcttagagttcaccattgctttcgcaatcgctttacggataccgctcattttttcgcgtgtttcagggaattcgccttcaggagcctgagctgctgcaggtttagctgtttcctgaggtgcagctgtttcttgcggtcccgcttcttgagccgctcctccatttgcaaagctgtcgatatcttcttttacaacacgtccgttattgcctgaacctgttactttacggatatccacgcctttttcacgggcatatttgcgtacggaaggcatcgcgatcacgcgtttgttcggatcagcttccgcttggtcctgctgtcctgcgccggtttcttttgcaggctctttaggagtctcttctttagagatatcctgccctgcttcagcagacgactgaacttgagcctcagttttcgcctctcctgaatcatggcttcctttaaattgaagatcttcgtaaccaggtgcgtcaaacgtaataatcgtttgtccaacagttgcaactgttccctcttcaacttttaattctaatacttttcctttaacaggtgaaggaatttctaccactgctttatcattttgcacttcagccagaacatcgtcttcttctacctcgtcgttcggcttcacaaaccattttacgatttcgccttcgtggataccttccccgatatccggaagtttaaattcaaatgccacagttttcgacctcctagttgattaagcaaattttagttatgcatacgcaagcattgaacctagtaaacagactccttcatcataagagaaaaggactctctttaccgtcttttaagatgcctgattaaaattcaagaacttttttcgcagtttcaagaacgtctttatggtttggaagccatacgctctcagcaagcgagaaaggaaatactgtatcaggcgccgcaacacgcagaaccggagcttccaggctcagaatcgcgcggtcattgatttcagctacaacgttggcagcgatgccggcttgtttttgagcttcctgcacgacaattgcgcggcctgttttttcaacagaagcaataatcgtatcaatatcaagcggacttacagtgcgaaggtcgataacttcagcagaaacgccttctttttcaagctcttcagcagccttaagcgactcatgaaccatcgcgccgtatgtgatgatagaaaggtcagtaccttcgcgtttcacatcagctttgccaagctcgattgtgtattcctcttcaggaacttcctgacggaaagaacggtaaagtttcatatgctctaagaaaacaaccggatcattgtctctgatagaggcaatcagcagtccttttgcatcgtaaggagtggaagggataacaactttaatacccggctgctgagcgataaggccttccaaactgtcagcgtgaagttcaggtgtatgaacccctccgccgaatggagaacggattgtcaccggagaagtccagcgtccgccggaacggtagcggagacgagccatttgtcctgagattgaatccattacttcatatacaaatccgaagaactggatttccataacaggacggtaatcttgcaggcctaaaccgagagcgagaccgccgataccggattcagcaagcggcgtgtcaaatacgcggtcctcaccgaattctttttgaaggccttcagttgcacggaatacgcctccggcaacgcctacatcttccccgaaaagcagaacgttttcattgtttttcagttctgtgcgtaacgcatcagtgatcgcttgaatcattgtcatttgcgccatggcttacttcgactccttcgctttgtaaatttcaagttgttctttcaagttgaacgtcggctcttcaaacatattctcaatcagctctgttactttcggttttgattcgccgtcagcctttttgatagcttgtttgatttcttctttggcctgttcaatcactttgttctcttcttcttcagaccatagtcctttgttttccaagaacttgcggaaacgtacgagcgggtctttttgctcccattcattttctatttctttcgtacggtatttagtcggatcgtcaccggacattgtatgaggtccgtaacggaatgtaagagtttcaatcagagtcggaccttcaccgttaattgcgcgctggcgtgcttctgcggttgcagcgtaaacggctagtgcgtccattccgtctacttgaacacctgtaataccgacggcaactgctttttgggcaattgtctgtgcggatgattgcttttctacaggagttgaaatcgcatagcggttattctgaacaacgaagatcgccggcgctttaaatgctccggcaaagttcattccttcatagaagtcaccttgagaagctccgccgtcaccagtgtaagtaatagctaccgcttttttaccgcgctttttaagccctaaagctacacctgcggtttgaataatttgagcaccaataataatttgaggtgataaagcgtttactccctcaggcatctgattacctttaaaatggcctcttgagaacaggaatgcctgatgtaaaggaagcccgtgccaaatcagctgaggaacgtcacgataacccggaaggataaagtcgtcctgttcaagcgcgaagtgtgatgcaatttgagaagcttcctggcccgctgtcggtgcatagaaacctaaacgtccttgacgggaaagagaaattgaacgctggtctaaaatgcggatatacaccattcttctcattaattcctttaactgatcatctgaaagatcaggcattgcgtctttatttacgacttctccttcagcatttaaaatttggaacgtttcaaactgcttattaatagcatcaaattgttttttgctatcaacaattgaagtttttgtctttgcagccattttttaaaccacctcttcttttgatttaacagggttaggataccgtttagccatccgtattaaaaacagtcttatcatgctctgcaattctaaaattaatcattcagaaattcacatagcgcttaagcaaagataatgacgtttaaactgtactaataaaaaaagattttttattagtacaatatgatcaacaaccatagtttacagtaattaaacaaagccgtcaattatttataaccttattttgaaaccgcttataaaacttaagatcatactgcgccaaactgtactataaaagactttaaactgtattataaaaacgctctactgtactataattaaaaaaaattacaaagagtaaattaagttatttaacttcgagggcaggctttgagaaggtgccgcgggataaaaacgggcagttagcaatcgtcccgcctgccgaacaggcgggacgatgcttttgtctaattattcaatacccgcccacacgatattcagcggcgtcagtacggcatgaggatgaaactcggaaatcggagtgaaaaatacatacgtaaaatcttcggctggatcagaaaacatgccgcaccaacccattccaagatgtgagaacgtgccttctgtcatgaaataatggtcaccggccggccacaaattaatgcctaaaccaaagccgccctcctctcttggcgctccgaagaagtaaaaaggaagaccgggctttatttgatttctcagcatggcctcgactgtttttcttccaagcagcttcttatctttcaatctgcctttatttctaaacatttcagctaacttccaaatatcttccaatgaagagtacagaccgcttgtcgctttattcggaaaatacgggtgatgacttttttccagctgtacgcactcgtgctcattgatcacacaaacttcttcttttaaagcatcaggcacataaaaaaacgttctttctaatccgagcgcttcaataatatgctttgttacatactgttcgtaggacatgcctgttactttggaaataatgatgccaagtatgacaaagccggttctggaatagttccatgcttcatccactccgtactctaaaggcgtactgaccagatagcttatccattcttcctcattcgttaagtcaatgccttcagccttttgaatatccagctcaaaacttaatcccgccgtatgagtcaaaaggtgtaaaattttaatgtctccgaaacccggtttatcaaatgcaggcaaaatgagcttgaccggcattttcagatcgagcagacctttttcgacgagctgcatgacggctgcagcggtaaacacttttgtcaaagaaccgatttctctgattgtatcaagctgaaatgtttgcttttctttttgtccgccggtaaattcccctaacgactcagccgcaaaaacctcgcctcctcttgatatcatataactcgcgcattgcagatctccattgtctatcatcgtctgataatggctgttaagagcgttaatttgtttcatatcaaatgccggattgcttattgtttgtttcattgttttctccccctgtactgtatgtatcgttttcatcccttacttactgatttcttgatgaattctgacaccgctttattaaattcttccgggtgtgtgatgttcggaagatgccccgctcccttaattttctttaattctgcattgctcagcagtttcttcagcctttttgtttctttctgatcaactacgctttccttctctcccgtaaggataagcgttcttgtataaatgtcttttaaaaagccgatcgtagaatagccttcttgttgatgtatcttcataaaacgttcaatagaagcatttaagaattgattcctgtataaactttcatattcatgcgattttcctatagctataaaatcatttttcagtttttcctcaacactgctttcagggtcttcttcgtattcggtgtaacttccggaaagaatgagtgtttttactttttcagggtattcataggctatcctctgtcctatcatgcctccccaagaagctgccgcaatgtggatcggccaagcaacccctatctcgttcagcacttcaataaaagtctgagccagcccgctcagtgtaaaatcggcgctcccctcactcagcccgtaacccggtgtgtgtatgacaattacattaaattggtctgcccactccttcatttgttctttccacatgtaagcagtggtagcaaaaccgcaaatcagtaaaattgtttcacccttaccgctcatcaatatttccatatgccgggcattttctgtgttagccagaaaatgaacggtttccgtttcttctgtctggtaaaaagcgatgagtttttttgcggcatcgctttgatcgtgctgaagggctcctttcttcagtctgctccaataatgcaaataatcgtctagatgacgattggaagctgtgccgagtattcggaaaggactttcagcttcttcttccgtaacgattgacgaagcatcaaaatcggctgcaatcgctgaatctcttaccagaggcggtgctgaacgggcggataacggattgaaattattttgtattttttctttttctccgtataacacgatcagctggtggccttggccgagaagcgagtgttcaaaagctttgattccggcagtattttctaatgggtgaagtccgtactcggttttcataatgtcttgaatgccggcatcaactgacatgcctccgtctttccagaaaggccaatttacagcgatggtttttcctgatctcccccctcctttctcatacattccctccactcggcaaaatgctccagaaaacgattggcgtaggcgtaatcagcttgacccaaacttccgatttctgaagagatggaagaaaacaaaacaaaaaagtctaaaggcatatttctgagcgcttcatccaaatgaatcacaccattgacctttgattgcagcaccgcctgagcttccgcgtctgttttattcataatgaaagagtcttttaacacgcctgcactgtaaatgaccccgttgatttcggaataatcagcatgaattttttccgctaaattgatgacctgctgtttatctgacatgtcagcctggatgtaagaaatgtttgccccgtcatatcggatgctgtctaatttttcttccatttctgctgtcattttcgatcgtccggcaatgataacgctggctccgtgatttgcataaataaacgctgaaataatccagccgatgccgcttaaccctccgattatgagatacactccgttttttacaaactttgcggccttttgccctggttgcagcgaagcatctttgtatgctgtcacccgccttttttgatcgccgtcatatttcacagcctcatgatgtccggcacttaattcattgagaagcaaagatgctttttcaatggtttgtcttgaagaaatctcaaccgttttacactttatattcggctgctccgcattaagcgttttaaaaaagcctccaatcgcggcgtaaatcggatttgtatattgatccttgtcatgtacgtacaaaaggttgatgttatcttttattttttgacggatcaacgctttacttaaataaaggattgaataaaagctgtgagtcaaatctaacgctgcctcagtataagcttgttttgacaggtaatgaatgattgacgccggaaacgctccggactttttcatatcatctaacagtctggtgtaatgagcagactgctccggattaaatttataatgcttttcatttaccatttcatattcagcggcggcttccgcataaataacattttcactgccgatgtactttcggatttcatcactcaatgaactgccgaaatcgaaaatcaatgtattttccttaggcacttctccggactttaatggcgattctatccattctttttgtaaatataaagattcaagcatcggcttttcagacggctctttcgtttgcgttttttctttaaaagctgcggccggcgtattacgcacatcatatttttcttctaaataagctgctaaatcatgaatattgttataatcaaaaagcaatgtcggatacaattgtgtatccaatctttcctcgagcattttcgatatatgcagcagctgttttgagtcaagacccagttcgtaaaaagattggtgtttgtccgctttatttggcggcgtgtttgtcacatctccaataatggatgacagctcatctgttaatgttttttgactgtcttggtgctgaactgtatcagagatagagtctgtaacgcgagctccgtatttctcctgcagatattccgtcaattcaccgattgtggagtaatcaaataataaagtcgggtacagctttgaacctaacaacagttctaattttttagataagtctaataactgtttagaatccaagcccatctcgtaaaaggaaatatcattcttcaccgtttcagcaggcttttcaatcatgccggctatctcttggattaaattatttctgatcatttctttattgttcgttacgctgccgacgtctttagctttttgggaatgctccagcctttgtattgatttttcatttctgactcttttcacaccgaatcgctcataataaaaagcaagctctccatcaggcctgtatacttctatgtccgcatataaaatgtctttagaaggcggctgcgttatactgtttttatcaatatacacaaaacaagacccggttgttttatgcagtgcccggaatgtctcaatatatatagggataaacgcatttgttccttcatccggcaagtctgatgtaaggactcccaacaggctgagagatccatccaaaaatgcggggtgcatgtaaaagtcatctgtatattcttttgaaagtccgcttaaactgacctctcccagaatataattttcaccttcatataccgtaccttccaatttcataaaatctttatgaatcaggccgcccctgcgcaaattacgataggcggcttcagcattcgaagtccggacggcccctttctttaatgcttcgattgaaattgtcttttcgtctatcgcattttttcttatgatttccgcctgcaagttgactgacgcttcaccttccgccttttcagcgacccatttcctgcttgttgtttcaacaagccagccgttttcttgttccgtaaactggaaggtgacttttttatcaaaatggactgacgtcgcaacaggttcacggaataaaacatgtttgatttcaaaacttcggggtgatatccctttctcagctaaaaatcgtgttattaaatccagatacgttacgccgggtatcgtacgcacttgatgaaggacatggtctgaaacaatataatcgtcatgtttgactaatacgctgaacctcatgcaactcgacaacctttcttcttttacaaagtaaagaaacagagcaggtgctactctgtttcatcaataatttcaagaagccgttttttattctgtttgatttgtttttttcgatttgaatccggccagtactcttttctgacaaactcggcaggcggcagcggagttctgacggaatgatatgaatcatccaggccgcttaccaaaaggtgggcgtttgttccgccgaaaccgaaagcgctgatgcccgccctccgttttccatccttccagcttctcagttctgtattcggataaaaaggcgacttttcaaattcaaagcggggatttggcgtttcacaattcaatgtaggcggaatttccttatgccatattgataaaatcactttaatgaaacttgccgctccggcggcgcttaataagtgtccgatattggtttttacacttcctactccgcaaaattgcgttttgtttgtgtctcttcggaatacttttgtcagagcctgaagctcaatcggatctccaatcatcgtgcctgtgccgtgagtttcgacgtagctgactgatccgggagtgatatcggctctttcaaatgcatcttgaataacctgctcttgaagcttaggattcggagtcgtaatccccattgtcgcaccgtcgttattaatagctgatgcttcaatgataccgtatatccgatttccgtcagcttttgctttctccagcggttttaaaagaacagcgccaaaaccctctccgggtacaaagccgtttgccctttcatcaaaagtaaaacactgaccgtccggcgaaagagctcctccttctgttaacatcaggtaaggaatttcatccaaaagcagatccgcccctcctgccagcgccatttctgaatcaccgttttttatgctttggcaggctaaatgaatgctgactaatgaagaagaacaagcggtatcagacaccatgcttggaccgtgaaaattaaagaaatgcgacacatgtgaagcaataaagttttgactaagcccgacgatgtggctgctgctttctttcggcagtttgtgaccgtagccgcccattctggaaccgacaaatacgccgactttttttcccgataattctgtttcttcataaccggcatcacgtacagtctgtacactcgtttctaagaaatgtcttatcagcggatccgtttggatggctttctcctcttccatacggaaatactccggatcgaagctgccgattccattaataaatcctccccatttgctgatgctttttcccttttgctgcaccggagagtaatgttcttctatattccaccgggaatcaggtacttctttaatatgattcttcccttttctcagattgtcccaaaattcctctttatcagccgcgcccggaaacttacatccgattccgataacagctatctttgcagtggaagccgtctgcggttctgtatttcggctcgtcacagactgcatatcatgctgattgctgctttgagaatcagtctgttcgatttgttttttcaacggcggcgccgtcttaccgatatattccgcgagaccatgaatcgtgttgtgttcaagaagcacagtagggtcgatttttttctgaatcattgcttctatacgatgtataatgctgacaagaagtatagaatccacaccgtattcctgaaaatccgtatttgggttaagcttttcaaggggtatgctcaattcctcggcaaatacggcagaaagttcactgacaagcccttctgaatgatcaaaagtgccgggagtctcctgtcttcgggccggaaatgaagtcttgccggttttattgatgttcaggagactgtctgcatgaaacactgttccttttttcacgataggaatgatattggccgattttttctccagtgcatgatacaaaatcgccagtccttcccgcgtggatagagagtccaatcccaattcatcatataaaggactcgtcacagtacccattccgacttctttccagctcggccaattgatggacgtgaaatacgttctccccttttgaaaatgataagccgcgaaatagtccatatatgcatttgcagacgcgtaatcagtcattcctttcgacagtttgggtgactgtgctgcaattgatgaaaacagaataaagaaatccagcggcctattattaaaaatccgctccaaattctgaagtccagtgactttcggcccgtacaccgtcttaaattcactcattcttttatgaataaaggccggatttccgccgctgtgcagtccggcacagtgtatgacaccgctaatatctttaaattcaaggcttacttggtgaaagaatgaacgaagcttctcttcatttgtgagagaaccgctgtaatacagatagtcgacacctttttcttcaaaactttgaaacagttttatattgctgactgtcttttcgtcctgtctgccctctttcagcaaatgatcccattcacttcgcaaaggtaatggacgcgtacccgtcagcacgagttttttcactccccgtttcaccaaatcttcagctattgctctgccaatgccccctgtcccgccggtaatgacgatggctttatccgcaggaaatgaaacaggaccgccgccggtatcgattctttcttcttcaaaatacggaacatatctgacgccgctgcggtagcatacttcattctctcctgtacattgcgccctttcaatctcaaagatttgtttcagcttatgcgtttctttcatgctgtctatatctattgttttcacatgaacaaagccgtattccgcagaaagggctttcagaaaagcagctgattctgcacccgtcagctttggtttttccgctttaaatacctgcaagccattggttagttgtaaaatggataatggtgtttccttttttctccgcttaattatttcttgtataaataagaatttaccatatgggatgccgttctgattttcactctggtttccgatatctgagaaatcaaatatattttcgacctgccgctcaccgcccgagaagatctcacagataacgtcgtatgcgtggttttcatctaataaagaacactcaaacatttgatcagagtgttttatatatgaagagtgatgttttatgacaatcagattctcctgatctatatccggacaaatggtgcgggcaattgattctgtgtcttgattcacaaatgcgactgtcagtccgtactcttttgtttcggatggatttacaaacggattctccctccattttttttgcaagtgatgttgagaagaatgctgagggatctctgtcctctcagtcctggacggaacccaataacgttcttttgcaaacggataagtcggaattgagatccgtttacccggctgctgtaaatgttgatgaacggatttccagtcgatatccgccccccaaacccataattgagccagcttttccgcttcaccgttctcaataatggtctttacaaacaattcgcctgctctgccttccgttaacgccttcattttttcagcaaatgcatctgattgctgattaacatatacgcctggaacttgcttgtcaccgcggcaaaactgagataatttatctttcatttctttaagagaggtaccggtaatcgccgctctggcctccatcgcttctctgcccgattgtgtagtgtatgccagatcccgtaaaacgacgctttccgattggccgccttccatcacttcattcgggaacatgtctcttatcgctccggcatattccttcagtaagtattcagtaaccgcttgaatggaggggcaatccgttaattcatacatcgtgagttcaatatgaaacatttcgttaataaaatccgccatccggcttaattccaaaggccctacgccaaattcactcaggtgatcagaaatattaatttcttccggatggatatgaagcaattccgaaacaaacggtttgagtacttcattcaccttttctttcatatcagtctgtttatcctttacttcaggacttagtgaacgctgaataaaatctttcatgttttcggcatactcaagaagacgttcattgtctttggcagataacaggacaatatgcggttcgttctcaacatgttctgttgagacgtttgtttcttcatattcttctataatgatatgaacattcgttcctcccgctccgaatgagctgattcccgctcttctcggaacagttactgtttttccgttttcctgcagtttcggtttcttccagtcttgcaatgaccgctgtacataaaagggagatgctttaaaatcaatatttggattcaacgtctccgcatgtatggaaggaaacagttttttcagtttcatttgcaaaagaacctttgtcaaaccggcaattcccgctgcggcctcaagatgaccgatatttgatttgacagaaccgattgaacaatattgagtgtgctccgtaaattcccgaaacgcttttgttaatccggtgatctcaatcgggtctcccagagcagttcccgttccgtgagcttcaatataactaattgtacgagggtcaatacaagctttctgaagcgcgtcctgtatcagttcagactgaccatttggattaggaaccgtaaaaccgtttgttctccctccgtgattgaccgctgtcgctttaatcagcgcataaatatgatctccgtcccttaccgcttccgccgccggctttaaaagtacggagcccactccttctcccggtacataaccgtcaccgccctcgccgaatgtacggcatcggccatcacttgcaaagaagcggctttgatttaataatgtatatttattcggatgaagtgtaagattgactccgcccgcaacagcaagtgtgctttctcctcttcgtatactttcacaggctaagtgaatggcgttaagagaggatgaacacattgtatccaccgccatactcggccccttaaaattaaagaaatacgatattctgtttgctattgcagaaaatggagacccgacggccagttcatttcctttaagtgattcttcaacgccgaaaaattgatagcttccatatgtgacgcctgcaaatactccgacctttttgcgggtcagatctgaaggtttataacccgcatcctctatggtattgtacactgtctctaaaaagagacgttcctgaggatcaagaaaagcagcttctttcggtgatatccggaaaaataaaggatcaaaccggtctggatttttcagaaaacctccccacttatagcagcttccctcgagcatttccttccggtcatcaggaatttcgcttacgcaatcccgtccattcatcagcacattctggaactctctgatgttttccgcacccggatatctgccgctgacaccgataatggctatatcagcagaaaggggatcggccgcaatgtgctcttttgaaccttctccttcagagcgtgccggcgcttttgtttccactggttttcttttttgctttttttgatatgaaacaagttcagatttgccggccgggttcagcagtttcatcattcgttcgctgtgatgactcaggaaatattcggctaactgcgatatggaatgatattcaaaaaataatgttttcgacaatctgccgatactttgctccagctttttggtcaggcgcatgatcatcactgaatcaatgccgtatttctccaggtattgtttttcatctatgagtgagaccggtaatttcaattcctctgacattatattttttagataactgatgatattttgtcttaattcatcgctttgtaaatcggcatcttcctgccggtctgaatgtaagctgattgtgccggcacgcttcagcacatcctcaatcttttcttttcggcctttcagggcgatcagctgttcagatgattgacacaagctgttctccagagcctgtattccgtcaccgtcatctagcgggtcaaggccgagttcctgtttcatgtaggatattccttcatcgtcaatattcatcccgccggaagtccatagcggccaattgactgacaccaccctttcggcagactcttttgcggtcataactgctgcatactgatccaaaaaggcattggcgaaagcatagtcacattggccggctgatccgaagactgccgatgtggatgaaaacaagacaagtaattcaactttcatttttttgatttcttccgccagccagagcgcgccataaactttcgaacttgtgacttgatcgatttcttcttttgtctttcttaagataaaagagtcacggagtacgccggcactgtgaaatactccatgtaaggtgccgaactgctcttttgcaaaagcaaacatccgttcagcatcactttgttttgaaacatcagatcggatatattcaactgttgaacctgaacttcttaaatattcgatcttttttttctgctcttcagttaaatcagagcgccctgtcaatatgagattcgctttccatttttccgacagatgttttgccagtatataaccgagaccgcccaggcctcctgtaatcagataattttcatgatgtttcagcggctgggttaaatcgaataagccggctttattatagcttttcgtaaaacgtctgccgttttcatagcgcacttcaaaatggatatcccgtttttcgtcacactctctctgatatatatcagctattgctggaagagcggctcccgcaccctctgattgagtgatattgataatctgatagtgaaaattggggtgttcctggtgaacggttttcaccaatccgccgagagcatgatgcagcggcagttgttctttattctgagtttgaaaaatatgcgtcagttttattatctttttccattttaattcaatcagcgcctgtgtaatatacagaagagaaaacaatccgttttccaattgtttctgtatacctcccttactcatgtcagcctgagaatcagaccacaagtgaagaatcttttcgggcggctgataatgatcatgaatgtatcggaacagctttagataatcgtcttttttcacgtggttcatacaaatcgtatcatcatgtaaaacagcaaattcttctccgcggatgacaaacaagagagtgcagtccttaaacaaaccgctcaattcttgtatttgccgttcattttctgcaaaaatcaggagcaatcccgtcaagggtacgctcttcgtactcggaatgaacgattctgtccattccggcttgtaatataaaagaggatggttcgatgcccgtgatttttgattctgaatggatgttacacgggcatagccttcgtcagccgacatttgtcctgtttgaatcagatcaagaatatcgctgatttgttcacgttttccgttcatcattcttcccccattaattgtttcaatacagccttctgatcaatatcattggtttccaattgacgcaggagacgaatgagttcatcgtccgtctgaacagtgtctttttcatgaccatatctgaatctcacatctctgcactccgccagaatgcttccgtttccatctgtaaatgtcatatgacacgttacatcacggctgttctgccggttcactttttgagtataaacataaaaattttgagcgagaggctgatagacatccgccgctcccattccgatcaattccgggaaggtttctccgctgacaaaaaatgcactggcttgaatcgcggactcaagcgcttcaggagaaatcgtaaaattttctctttttgcataaagctcatccggcattgaatgaagcgacagcattccgtaactgtttttcgctgattcaatgacaaaaggcgcttcagccggatgttcagtcatttctgatttgacttcagcaatatcaagcgcttcaggaagcataccgctttcaggcttaaccatatgcgcatttccgctggcaagacgtactttattctcattttttgtgtttgcatatatgtcaaaccgcgcaaagtcacgctcaggcgtcagcgtaatcatcagttcccgtatatctgtcattccgttcatgctttcggtccacaataaatcggtcaatgtttgaactggttgtccaaatgccgccgctgcattgacgatagccatttcagccaaagatgcataagggaaaaaggacacgtttccttcagacagacttagtgcgaacggatgattacggctgatttttttcgtgaaactgaactgatgaaaatcggacgtgttactccccaagaaagggtggcccgtcttactcacatccgctgaaacaagtgcttcccctttttccgctatccaataccgctgtttgatcagcggttgtcccgggatagaaatcctgcgggcattccgattcacctcaaaagtctcccaatctatctttcttccatttacccatttggatgctgcttcggcgtaatctgaacaaacgtgaggcatttcattgtgaacttctgattcgaatgtattaccggtatggctcaggctgcttttttcacccctgatataagctgaaagctcttcagcaatgacctgcccggaatctgccactatcgccagccgttcttccatatgatcgcgtcccgtctgaagtgtataggcaatatcctgaagacgcagtttatgattgttatccttcgattcattttctgatagaaaatcagccataacctttgcatattttatcagccgttgtttgtcttgagccgataaaacaaagatcactcggccgctttgatgatcaaatgcttttggcggttcatacgcttccaatataagatgcgcgtttgttcctcctgccccaaaagcgcttaccccggctctcaaaggatgaacagcatggctgttttgcggaatattccattcagccgctttccgctgcacttgaaaaggaacctgatcaaaatctataaacggattaacaatatcggaatgcagagaaggaacaagctgcttattcttcatttggagaagcactttcgttaccgcagcgattcctgccgcagattctaaatgtccgatattggatttcaccgaaccgatggcgcaaggatggttcaattgataggaatctttcagtccttgaatttcaatcggatcgcctaatgatgtccctgttccatgcgcttcaatataattgacggtgttcggatcaatgtcagctttacgaagcgcttctgaaatgacctccgcctgcgcatccggattcggtatggaatacccgctcgtctttcctccatggttaacggcgcttcccttaatcacgccgtatatttgatcttgatcttctattgcttttttcaatggttttaacaatacggctccgactccctcaccgggaacgtaaccgcttccgtcttttccaaaactccggcatctgccgtcacttgatagaaactgtcccatgctgaggaacttatatttattcggatgtattgacaaattcactccgccggctaatgccatatcgctctctccgcaatgtatgctttggcatgcgtaatgaatagaggtcaatgatgaagagcacattgtatccagagccaaactcggaccttttaaatgaaaataataagacacccgattggcaattgaagaatagacggaagccggcgaaaaagccgctccattttcttctccttcaaatagttgatattggccccacattgcaccgacaaatacaccgactttcatcttttccagcatgtttctcgggtaccctgagtcttcaaaacaatttttggccgtttctaaaaagagtctttcctggggatccataagttctgcttcccttggggaaatatgaaagaaaagcggatcaaattgatcggctccgctgataaaacctccccacttgctgtaagacttccctttcatatctctgtcttcgctgaagaaatcatctatattccagcggtcaggcgggatttctgtaatacaatcttttccgctctttaaattctcccaaaattcaggtaagtcttcagccatcggatactttccgcttaaaccgataatggcaatgtcttgatgccttgtatcagctgtttcatttatttggatctcacggctttcatcctccttgaaggtatcttgaagtgcagattccaatttttctttgtcaccttcaaacacgatcagctgtgatgcgttcatagagagtgaatcttgaaaagctttgatcccattggttttactaaggggaaccataccgattttttgtttcatccatttttcagtttgtttatccactttcatgccgccgtcttcccataggggccagccgatggctactgagacgccggagcgttcttttttccgcctcattccttcacgccactcagcaaaaagatcgatgaaccggttagccaatgcataatccgtctgtccgatattcccgtacatcgagctgcttgatgaaaacatcacaaagaagtccaaaggttcggtttgcagcaagctgtccaataagaccgtcccatttattttcggagcgatcacttcctgaatttcatcttttgatttttgaatcaataaagcgtcgtgcgtcacaccggcactgtgtatcacaccgttgatttctccgaatttccttttaatagtttttatgattcgctctgcatcgcggctatctgaaaaatctcctcttatatattgaacggaagaaccgcctgctttcattcggctgattttgttctttttgtcttccgtcagttcagaacggcccgctaaaataatattggctttcgtttgcgctgcgatatgttctgcaaatataaggcctaagccgccggcccctcctgtaatcatgtatactccgttttctttaaaggagaaatctgagttttgagccggttctgcttcccgtaaggcacggacccagcgcacatttccttcataataaagatcggtttctcccggatgcgcttcagttgattcgcatctgatgatttcagctgtaagagccggcaacgatgtcttgtctgaaactgatatcccgattgtcttaagggccagtttcgggttctcaagcaaaatagactgccctgcgccatggactgaagcgtaaagcggctgatcatttttatggtccgccggataaaggaaaagcgatacaacctttttttccgccttgctgcgcatcaatgcccggctgaaaaagaatagcgggtaagcccctttagaaagctgttcacttattttttccgggccggcaaatgatccttccggccacccgtacaccacggtgtcgggcatttgccccctttttttcagatcagctgcaagcctgtcaaagtgggcttcctccctgtgatctatctcataaattccgtctccgtgataggagaaacgattccctgataaaacgagaatgatctgtgtattttcgaatccattttcagcattttcccgcataaaatgaaaaagctctctgtcatattgaaacagcagacatgttcttttctttttatttccgcaatgcgggtcccaagcggcagccttttgtctccaatacggcgttaaataggtcagagccgtatgattctctccatgatgtagagggaggtctttgtcaacggaagtcttttcgccgctctccgcaaaataatttgcaagtttttgaatcgtcggatactcaaacaataaagtagggtacagttccctgcctgttttctcctccaatgcctttacggcttgcataagtgtgacggaatccaggccttgttcataaaaaccttttaccacagagagtgtttcaggggcagtccctttgatgtctgcgatcagctgctgaatgtctccttctgttataagagcggaaagattttcgttcttactttctttcatgtcaggcttttcagccggttgattttgcgttaagaaataactggacattttttgattttctttaatatacgcggcgagttcccggatcgttttctgctcaaacaggagtgtaggatacagctgttcccctgttttgttttcaagttctttgacaatggcaagcaaagaagcggaatccaggccttgttcataaaaaccaatgtctgtccttatgtcacgcagatctatatttgaaaccccggatattaattctttaaggtgtgtctcaatgctttcgcttcgatctatgattgaatcttttctcatcaggccgtcttttggctgagaagccgcttcagtttctaaacgagtctgcttcagattttcaattaaatcttttgagcgaatatgtttcacagacagccgtgtaaaataagcgatcatctccccgtgtgcatcgtacaaaccgtaactgacttggatgacatcccctgaatcatgattttggtcttgcttctctatgtacacataacacctgtcttccaggcgcttcgtcatacggaaagattcaatatgaatgggaatatacgttttcatccggcttgccggagatccttgtgtaaaatattcgggacatgcctgataaaggatcgatatgatggtagacgcatcaagaaaagtgggatgcaattgaaaatagccggtatattgtttggcaatttggctgagcgacaactctgcaagtacagaatgatcagacgcataaaccttccccagactcttcataaattcaaaatgctctatatcaaccttttttaaatagtcatagcatatctccatatcggcttcacggacggaggcatgtttgatttcatcgatatgaattgaactcatgctttccgggaatttctgcatgagcctgcagttcatattctcatcccagctttcatccagaatccggtcatcttttacctttctgctcttcgcctggatttcccatccctgttccaatccctgaaaacggatgcggatttctctgtcaaaggtgtccgatgttgctacaggttccaaatacaaaatattctgacactcgagttcttcaataggcaaacctttactcagcgccatacggtatatcatatctaaaaatgtgacaccgggtataatccgggtgccatgcacccggtgatccctgacaatatagtccgtatgtttaattgttaatgtgaactgatagttttgattactggccacctgtctcattccttttcttttctttataattctttgaaatcaagtaaaggaatcagcaattctgactcttccttttctggagcttctccattgtcgatccagcattgttccttattgaatataaccggagaaagcgggtgtctttttgtctctccatatcctaacgtgagatggctgtcgctcaatatcatatgtgcgttcgtgcccccgaatccaaaagaactgattccggctctcaaaatcccttttctgggacgccattcttttaaagacgtgttcggaaagaaaggcgactgatcaaatttaaaacgcggatttggcgttttacaatgtagtgtcggcgggagcatctgattttttatggataaggcaacctttataatactcgctatccccgctgcgctcattaaatgtccgaaattcgtttttacgctgcctactccgcaaaattgcgtttcttccgtaacctcccggaacacttcagtcagcgcttttaattcaatcggatctcctatcatcgtaccggtgccatgcgtttcgacataactgagagtatctgcatctattccgccttttttcagggctttttttatcactgcgctttgcgctttcggattaggtgttgtcatccccattgtctgtccgtcattattaaccgcggaggagtcaattaccgcgtaaattctgtcaccttcggcaagggcgtcatcaagtcttttcaaaaggactgcgccgcatccttctcccggtacaaatccatctgccttctcatcaaatgtatgacattttccttcaggtgaaagcgcccgagcctcactcagcatgacgtaaggcttttgatccagcaaaatgtcaaccccgcccgcaattgccatatctgactcttttgacatcaggctttgacaagcgagatggacgctgaccaatgaagaagaacaagccgtgtctacaaccagattcggtcctttcagattaaaaaagtgtgagatatgcgcgcctatgaaattttgtcctatacccacgatcgtattttttgaaggggaacctattttggacataaacgtcccggtgcgcgaaccgatgaaaacgccgacttctttgtttgatacttcttcctttgtatagccgccgtctctcaatgtctggacgctgacctcaaggcattttttgattaacggatcaagctctgatgcctcacttttgttcatattaaaaaacgcgggatcgaaagactcaatatcttgaagaaatccgccccacttactgatactttttcctttttcataggtgtcagagtagtatgaagaaatatcccatcgcgacgccgggacttcacggacactatgttgtcctttcttcaaatttctccagaatgtttctgtgtccggagcatccggaaactcacagcccattccgataatagcgatttgattcagactggttggttgcatttgagatccgctgtcccgtacttcggaagcattttgatttatatgttgctctttattccgaacctcaatattttctgaatcaatttgaggactgatcccctcacttgcaaataactcgttcaaatagacgcccagttgtgaaaaactcggatactccagaaaagccgaaggttcaatttttatttgaaatgcatcttccgcttttttgacaagctgaaccagtaagattgaatcaactccgtaatccgcaaaagacgtatcctgatctaaattcccgtaaggtattttcagctccgcggaaaaaatctccattaacttcctgatcatagcttcattgtcaccatgaccagagatcactttttcctcagcatccgggttatttttagccgcttgaattcttgtctgaagcagctgcttcagcttgaatttctccggatgtgtctttgccggtataaggcatggatatccgtttatcgtcatgatttcatccagcatggaaatacctgtttctgttgagtgtgaaagtaaaccgagtgcctgatatgatggacttgtcacctcgcccatcccaatgtccttccagctcggccagttaattgattgataatatgttttgccggctgcatgctgatacgccgcaaagtaatccataaaagcgttagccgcggcatagtcacttgttccggcgcctaataaaggaaaagcgctcgcaacagatgaaaacaaaatgaagaaatcaagttcgtcatcaataaaaacgtcatgaagtacttgcatcccctgcacctttggctcaaatacttctcttatttcttgatcagatttatgaataaaagccggattcgaatgattggctgcaccagcgcaatgaatcaccccgccgattttgccgaacttcattcgcacctctgaaaagaagcgatgtaatttttctttttccgtgagcggcccggaatacacttccacctgaactcccttttgatccaactcatgcagcagttgtaatttcgaataaagaggtgacttttcatcggtgtcttctaacatgccggctattttatcagattccggaaggtcggttactcccatcagcacaagttttttgactcccttgccggcataatgtctggcaagttctgctccgatccctcttgttccccctgtaataaccaaggtttgatccgtacggcataccggcagaccggataggttccggtttatttccgccgcatttaatttctcgacgtatggaatataacgatcaccgttccggtagcagatttcactatacagcccgtcagcgcaagcttcatctgtgattacctgtctcagttccgccgcagtcccgacatgcccgtctacatctattgtttttgattttatcttttgatactccgcgctcagcattttatatagtccggctgtttcggctccggctaacgacggcttgtcattcagaagtgtctgcagccctcttgtcacatgtaaaacgaaaagctttttacgtgtctttatgatttcctgcagcagtgtcagcttcccgattgtgccggtgcgtgccccgttttgattactccgcaaatctgacaggtcaatcatgccgatgatttccggattttcttctatgactgctagagccgtttttttggcttccccatccgaatgatcccagttatctgcgcaaatgacagcgggttcaatcagaggatctgaatcaaacaattcgaatgcaagccgctcactttcactattagccaggatcatcacctgtcctttcgtaaaagcggaaggcgcagccttttgttttttccacgatttttttaatacatcaaatgataagtcagtcggtgcatggggcagactctgcggtacacctgttttctgtttctgtgctgcttttgcggcaggcacccaatatctgttccgttcaaaagggtatgcaggaagagaaataagcttcggtaattccgcagtgtacatctcttcccattcaacgtctcctccgttcacccagtgaatggccatatctcttgcattttcaaagtgagcggctgacagggcattcttttgaccggcgcctcggcgggcgtttcccctatataaaccgtttaacttatgatctgaccgcaaatacatcgtcagcttatcgcgaagatcgtcaaggctgctaacctcaacagcgagccgctcttccatagcgtttctcccggtctgcgaagtgtacgcggcatcagctagtgacgtttttggctccagttcttttatatatgcatcaatcaagagtctgagccgttcttcatttttggcagaaagcagaataatttgcgtcttgttgctctgtaccgtttccatcttttcttcattcttgtactcttcgatgataatgtgggcattagatcctccagcgccgaaagaactgatacccgaccttctggcttgattttgcggcgtctcccaatcggtcaattcagactgcacgtaaaacggtgtttcctcaaaatcaatattaggatttaagttatcggaatgaagggaaggagcaagctgtttatacttcatttgcatcagcacttttgtgatagaagcaattcccgccgcggcctctaggtgtccgatatttgacttaaccgaaccaattgcacaacgataatcgcttttcgagctgtgcaaagctttggttaaacctgaaatttcaatcgggtctcccaaagatgtccctgtgccatgcgcttcaatataacttatgctgtctgcatcaatccccgccttatcaagagtttcactgatgacgtttgcctgctcgcccggatttggcacagtgtatccatttgtttttccgccgtgatttacagatgttcccttaatcacaccgtaaatcctgtccccgtcagcctttgcggcagaaagcgatttcaaaagaacggccccgactccttctcccggcacatatccgtctcctcccgctccaaagcttctgcagcgcccatcgcttgaaacaaaatgattttgtgaaagtaaagtatatttatccgggtgtaaggataaattcactcctccggctatggcgagggtggattctcccctttttaaactttcacatgcaaaatgaacagcagaaagtgaagaagaacacattgtatcaattgcaaggctgggtccgtgcaggtcaaagaaatatgacacccggtttgcgatagacgaataagaagacaagagcgcctgacgtccctcatcatctgaagcaccggctgcaaataactgatagtggctgtaggtgacgccgacaaatacccctgtcttatgccgtttcaactttttctttgtgtaacccgcatcttcaaacgtgtgccatgctgtctctaaaaataaccgttcctgaggatcaattaactcggcatcacgaggcgaaattgagaagaacagcggatcgaatttatcagcgtcttttataaaacctccccatttgctatcatgacgggcattgtcacctgtgtgataatatttccgaaaatcccagcgctctttcggtatttccgttatacaatcttttccggaagaaatattttcccaaaactgttccacatccttcgccatcgggtagcggccggctataccgataattgcaatatcttcctcggaaggtgcggatggtatgcgggaaacggaaagcttctcccgtttcgccggcgccgaatgatcaattcgctgttcggctgccggtaaaaacgccttcttcaactcatgttgatagtgttcaagaaaatactctgacagctcttcaacactgctgtattcaaagaaaagagtcttagacactcttccaaaatacttttcgagacgggagttaagacctaaaattgttagagaatcaattccgtaacggtcaaatgtatcctcgggtaaaatgctgtccgccggtcttcccgtttccgcaccgacgatctctgtcaatagacggatcgtttgctttttcagatctttttcatttaattgcggcagactgttgttttcaggcacagtctctatctttttatggtcagttgagagtaattcacttattctatctttgtctccgctgataacagccagctgagaagcagaacggctcatactgtcctgaaaagcggcaagccctgcttgggcagataaaagttccagccccgtgtgtcttaaagcctgcagctctgccggaccaactgtcatattccccgcatcccataaaggccaattaatagaaagtgttttcccgggacgtcccttaatgcttcgatactgggtgaatccgtccatacatccgttagcgaaggcgtagtcgctctgacccgcattaggcagaacggccgaaagggatgaaaacataacgaagaaatcaagaggctcttcttcagctgctttatccagccaaacggttccgaatactttaggcgctataacttcttctatgctttctttcgctttttttatgataaatgcatccttaacaagtccggcactgtgcaaaattccgtttaattctccgaatgtctgcttaatgtgcttaattaacgcgtccgcctctttttcctttgaaatatctgccgggacatataaggcttcagcaccgagattttcaagcgcgctcaatttttgcgccgtttcacgggatgccggagaacgcccggttaataccagcttgacttccgcctgtttcgccagatattccgcaaacagatacccgaggcctccggctcctcccgtaattaaatacacaccgttcttttttacactgaaactatgtttctccccatcttctttttttactcttttaagctgccttttataataatgcctcggctcataacaggtaaagtggtccgtcttgcattgattgttccattcaaaagagatgacatctgcaatatgctgctttgtaaacggctcgtcaaacattgatttcagctctgcagccttacatgtgaaattcggattttcggcctgtacggtcttaagaaaactttcaaccgcgttataaatgggctgaacctcgccctcggcattttcatacagaaacaaaacttctgctttcggacaaagtttgttcgccatgaaggcctgaaacatttgaaacaaggaaaacagacttttattgagctgctttcttattgcatcttctgtatttttgaagagcccggcagctaaaaaatgaataatatggcggggtcttatattttgagaacgcagaaccccgcatagcgcatcataatcctcatcatttgcaaagttcattttaaaacgaccgttccggcaatcttcgaaacgctcgccggaagtcacgtaaatgaaaggcgcctcatagccttcaagctgtctcttcattacggtatacatgctgtcgtctttgcaaaaaaataaaattggctctttcgtattcgggaatttttcactgcctttaaattcatgtctatcccataccatttcatatagatgggttttccccaaactcttaattaattccagcccttcttcacgcgtcaggctgccttctttcacctttttcacgatttgctcaatttgcatcgttttttcattcatggaaaagcaactcctctatcagctctgacgtctctttcgtattcatctcacctgtttgtgctttttcaagaagcgacatgatttctccatctgctgtatctttatttgaattgtgaagctcagtgttcgagaaagcctcaatcttctgcgcttcatctttatttaaatgaatccaatgtctgttcttactgaaaggataaagaggaagaggccgtttaaccggtttgagttcctcctcatacaagtcttcccagctgatttcacaaccgatcgtccacaactgagccagtttggccggcttgttttgctgaatcagtgattgaacatatgcatgaccttcggggccgccgaataaaggagcgtacagactatcaaaatccgttacatttccttcataaacaccttgcagtctgctcccctgaatgtaaccgtttaatttttcaagaagatctccggtattcgagcaagtgatcgcaaggcggcattcaaatggttcccttccggtttgcagcgtatatgctatttcttcaagaccgattccggacttttctctaaaattgccgttatacggtttatcagctgatcgattccagacgctgctgatatagcggcacagctcactcagggtcattaattcctgaaatatatctagtgatatttctgtgccgtacatttggtttatataagagattaattcggaataagccaacggatcaaatccgaattccgaaagaggtgtctttgcatctatatttgcggtatctaaacgcaggatacccgctgccgcttcccgaaccgcctcttgcacatcacgttcctgcacctcttgctgactgaattgaactgatagttcttcatgtaaaaacgctgttaactctttggctttaaccatcagcctttcctttgttttggccgatagaacaatgatttgatcccgctcggcagttactgctttatcttgtccgtattcaaattcttccacgatgacatgagcatttgccccgccgaatccaaaggaactgactccggcgcggcgcggaatttcatttccttttcgatcttttaatctggcccacttcatagttttattgacaatatgaaacggtgttccgcttaattgaatgtaagggttcagctccttaacatgaagtgtggcaggcaatgttttatacttcatggatagtaatactttaatcagccccggcattccagaggcgggctctaaatgaccgatattcgtttttactgaaccgatgccgcaatattggtcatgattctttcctggatgcggctcaaaagatccaaacgcttttttcaagccttcaatctcaatcggatctcccagttctgttccggttccgtgtgcttcaatataagatatcgtatcaacaggaatatcggcatttttgtaaacagacgttattagttctgcctgagcttccgggttcggagcggtcaatgaagcagatcttcctccgtgattttctccggttcctctcaggactccgtaaatattgtctctgtcattcattgccgcttgcaatggtttcaataacagaacagctgcaccttcaccgcggacataaccgtcggcaagtttatcaaacgtcttacaccggccgtccctagacaaaataccgagtttatcggtatacatatgcgtgactggatctaagagcagcgaaaccccgcctgctaccgccagctcactttcgccattttgaatcgagcgcacagctctgtggattgctacaagactgcttgagcaggctgtatcaatggactcactcggacctctgaaattaaaatagtgggatacacgattgctgatgagcgcctggctgtttccggttcccgcaaacgcatgcgccccgtccgaatgcctcatcagcagctggcggtaatcattaaattgaatgcccgtaaacaccccgatatgtttgccggacagctttgaagctttgtaacccgcatcttctatcgctttccaggtttcctgcaaataaattctgtgctgaggatccatgagttctgcttcccgcggattaatattgaaaaacgcctcatcaaatttatcggcatctgtgataaatccgccccatttcgaatgtacttcgctgcttcctttgccttcggcgtattttttccaatcccatcgatccgggggaatttcctgaatcgaatctttttcattgattaaattgatccaaaactcatctgcattttttgctcccggaaaaacacaactcatcccgataatggcaaccggctgcttctccggatgatggtcagcctgtcttgctgtctttttttcaaacggaaaacttcgcggcggcttcacggttttccctgcggttttcccggcgtgcactttccttttttcagaaatatttttttctgcacctgtattcccttttgcaacagtacgcagttcactgtttaggaattctgaaagagactttatatggctgtaagtaaagaaaacggcaggtgtcagcttaagcttgtattttttattcagtctgacagctaatgttttcaaactgatagaatcaaagccgagattgccgaaattctctgccgtatccagctgttcaatgttaattttcaataattccgacaccatttgtttcagttcttcaaggacattgtctgcagaacccggtcctctataagaactttcctcttgacgaaccggaagcgtatttactttttgatgcggcagatctttttttgctggtgttgttccggcatccccggtaacaaccgaaatttgcggacagtcacttgccaaaattgtctcaaaagccgctatcccttcttccgtttccaaataatcaaacccggatgcggaaagatatgcgtcttcagcttctttgtttaaatgcattccgcctttacgccacaacggccagttaatcgaaatgctcttgccttgtctctcttgcctgcggctctgttcggatctccaatttatatattgatcttgaaaataattgcccaacgcatagttaacctgtccaaaatctccgaagaccgaagaaatagaagaaaatacgataaagaaatcaagcggctcatctttcgttaattcatctaagcataccgttccttcaattttagcagtcatgccttccgtaaaatcagtcagattcatctctgtaaataaccgatcatcggcatgaccagctgaatgaataacgccttgaatggatccccaagtccgtttcgtttcttctatgacccatcccatcgtcttttgatctgcggcatcagcttgataatataccgcgtctcctccaagcgcctgcagccggtcaatgttatgtcgtttatcagctgttaacggtgatcttcccgtcaatactaattttgcttgatactgagaggctaaatattttgcaaaaatcaggcccagaccgcccaaaccgcccgttatgaggtaaatccctttctgtttcagctgatgagagtgctctgtatgattgaatacatactcctttaatgtcttaacatacctcttgtcatttatatatttaacttcttccgcctgccgttccacgcctgaaaccatttcgttaagacaaaattcagccattttttcaattgatatacgttctgaaaaaccgattgacttcacattctctgcggatggcaccaacatatttgccgtttttaaacagcctgcaagagcgcccgtatacggatcattcatgccttttttaaaagagtgaacaagaagcagagaatgaagataaagagaggcgtcactgcgggcgctcagggcttttaataaataaaaaattgattccaggccgctgagaaggcggtcacccgcgtaaaatgtttctcccgtgtgcaagatgacatcaggagaaaacccttttttctccaattcttcgaataaacgaatataatctgacgtcacttccgggtttatacagaatgtcagcagattttgatcggtctgccgctgatccggcgtgacgagaatgacacggctgtctgattgatttttcagagcttcagccaacgcttcatcttttgcaaagaccagaattgtttttggctccctatctttcatttcaatcagagggtttttttgatcccactcatgctcataaaaacgtacatttttattaggcttttcgccaaaaaccagcccgctcagttccatcaaaatcccgccggcattgtctaatacatacacatcataagccgaatcgctttcttcagtttgttctgcatatacataaacgggttcagtctcatgatcaaaaatcgtacattctttaatattttccggggtctctccggcattttcccccgcaaggtatacgacggcttgatatgcgctctcaatcacttccggtttgattatgcaccctttcggcccggcctttgcttttatctttaaaagcacctgtccgttcctgctgacgcagtgctctgcggctttcagactgtcactgcagctgtatccgaattcggcaagccgctgataaaacgcttcgtacggtatacggtctgcgccctgagacaggaacggctcaagatgaatatttccgttctcgtacgccccgccttctaattcgagccgccctgaggaataaatggataagtcgctctgtttttctatagaatacgatgcaccctgattatccggggttaatacaatccggatctgctcattgcttccgctttgtaacatcggttctctaaaggagagctcagttaatttaataatcggattccctgaagccatcgctccggcagctctcgccatttcaatctggctgagaaacggaaacatttccttgtcttgatactttgtttttatatacaaaccggtatcgcttacattgataagaaacttctgggctttaaaatcagatatattgcatgaaatgtaaggatgcagatcgttatttacgttcatccggcggcttcccgtattttgcgcatctattctgcatagctctttggcaaatggatatcccggtgctgatacccgtctcaaagtgacatctttataaagtgacagccaatctactccattaccgccaacccagtattcagcaatcttcacaagatccctgtttgcggctgattcttcaatttcagctttgttcgtcctttgagcttctgttgtgtctttgccgcttgtaaaaatatgatccctcgcatttccgagagtatagtctgtcagccctttaagcaattcatctcttgtggaggcgataacagccaatctgtgcggcatttcttctctcccggtttgtaaagtaaatgctgtatttctaagtgtttctaatgaataatctctggctgctatttgttcttttgcgcgttttgcatattctgccagcctgtcggcattttttgcagaaaaaacaaataaaagctgttcaggttcttcagccgcgagaggagagatagcttcatccgcaaattcttctaaaataacatgggcattagctcctcctgccccgaaagaactgattccggcacgcctgggaacggatgactcccatttttcggctctgtccggtacataaaaaggtgttttttgaaacggtatattctcattcaattcagcagaatgagtcagtgacggaacaatcgttttatgtttcatttgaagaataactttcgtaatgcccgctatgcctgcagcagcctcaagatgtccgatatttgatttaaccgacccgatcgcgcatgtcttcttatcgcgttcggcacctgaaaatgctttggtcaggccggtgatttcaatcggatctcctaacgcggtgcctgttccgtgagcttctatatagctgatgcttttgggatcaatacatcctttttttaaggctctcgtaatgacctcactttgagcttttggattcggcacggtatatccattcgtcttagcaccgtggttgatcgctgttgccttaataactgaataaatctgatcaccgtcggcaatagccttttttacgggtttcagcagcacggcacctgtcccttctcccggcacatagccgtctcctcctgaaccgaagcttctgcaccggccatcactggataaaaatcctccttgagtcaggagttcatatttatgaggatgaatggataaattgacgcctcctgcaattgcaatttcacattcattcctgattaaactttcacaggcaaaatgaacagccgttaatgatgaggaacacatcgtgtccaaagcaatacttggcccgctgaaattaaagaagtaggatacccggtttgcgattgatgcaaatgaggaagaaacggccgcttcgtgaccaacgctgtacagctgatattggccgtacataacccctgcaaaaacaccgacgttttttctttcaagcgttttctttgcgtacccggcatcttctatggtgtgccaaaccgtctctaaaaacagtctctcctgcggatcaattaattcagcttcggcaggagaaatattaaagaacaacggatcaaaatgatacacatcgtcaataaatcccccccatttgctttggttttttacttcgtcgcccgccgcaggctgatagtgcagcctcgaatcccaccgatcctcaggtatctcagttatacagtctttaccgttcaataagttttcccacagagtatcaagatcatttgccatcgggtaacgtccgctgataccgataatagcgatatcattgtcatgatacttctcctgctgcacctgatttttcatctggattttctgtttcccgttaacatcggctgtctgtttattatcttttttcttctgagatggagtgccgctcccgttttctcctaaccggagtttatgaagaagagtatccctgtgctcctcaacgaaatactgtgacaattctgccgcagtctgatattcgaataacagcgtttttgagagcgcgccgaaatgtttttcaagctcattcgtcatattgataatcataacggaatcaagtccgtatttttccaatgcctcttctgcatctattttgtccgcaggcatcctgaattctgcagcaattatttttatgataaaatcagatgtttcagctgtcagtttctctgaatcaaatgattcgatatttctccctgttccttcatctgcctgaatattgtcttttcgttcatataattgatgaacatgattgtcaatttgctcatctccgtaaaatacagtgaattgcgaaaaaccggaggacaatgcgacggcaaacgcttttttaccttcttctttttctaaaggataaaaacccgcctttttcattgtctctaccgttcgctcatccacttgcatgccgacttctttccacagcggccagttcagagagagagaaatcgtatcagaatgctgggcagaacgcatattcataaaatgatccatataactgtttccgaacgcgtaatcagattgcccgacatttcccaacactgcggaagtagaggagaagcaaatgaaaaagtcaggattttctttctcaacagcatcattcagccacatcgtacccaatactttcggtctgattacctgatcgaattcctctcgtgacttgttaagaaggaaagaatcccggatgattcccgcgccctgaatgaccccgtttacttttccataagaagttttggcttttttgactacatattcggcttcttccttattggtaatatcagcctgaacataaacagctgaagaaccggcatcctccaatcgcctcagctgttttcttatatgatctgaaagcggagatctacctgttaaaacaaggcagcattttgtttgaaaagccaaatattctgcaaaggtaaatcctaatccgcccgcgccgcccgcgataatatatactccattttctctcagcggcacagctccgcttccggaatttttttcgggttcatacgttttgagctgtttgacataacgctgcatgtctttataacggatctctacatctgaaggctggaaatcactcagctcattgcgtatgatatcagctgcgtgaacggctgctattgactgctccatttcaatgctttttgctgagattaacggattttccagctgtaatgtccgcaaaaatccgcttgccgccgcgtaaagaggctgttctccggaaagatgcgaaaaatatccatataacagcttgatcggtttgcggcagttatttttgaagagcgcctgttgtaataaaaacaaagaatagactccgctgtcgcattgttcacgaattgctctctctgttttttcaaacggcatgtctgaccataaatgcaccgcttcccgtatatctgacttctcttcttctataagccatcctaacaggtttatgtaatctttttcagagcgggggtcgatttcaaatacaccgtccccggtttttcgaaactctttccccggcttaaccaaaataacccttgtatcatgcaatgcagcaagttctttactcacatcttcatttttatcaaataataaaaggctgccctcacgccggccgccttttacatgtatgctgagatctgtccgctgccagaccgtctgataatatatcgcctgtccgttaccccctgcggaatgagaaccaagctgctgtatccgctttactccttcttccaaagaaatgatgccgctttctatgtcagaaagtactttttttctaatatgacgggcttctttcataaaaatcttcatcccctttacaaatggcactgccgcaaaatgataaactaatcctgcatatgctccagcgcataatctgcttcttcggcagtcagttcgcccgcttttaattgtctgagaagctcttttactctctcgttctttccattggaatccgctgttgcacgagtctgtgcctccgcggaaaacgtttcttttttacgaatggttacatccttcaaacctgcaagtctttctccttgttcattaagcagctgaatatcgtaaataagctcggattgacctttttggcctgttttacgcgcatatgcccagcattctgctgaaacttttttccgaatcgtaatctctcctattgaaaaaggaacataaacagatgcctcttctcttccgtccgtaatcccgaacaaagattgcagagccccatcaattaaagacggatgcaatgtataattttcaagagcatatgcggcttcttttggcagcaataagtgtgcaaccgcttctgtttttccgccccataaacgttgaatcggctgaaaagcgcgcccatacaggaacccgttttcccgaaaatacttgtaacattcatcttgttcacggacaaaagcacttctgtttatcatctcttgtctgtcgatattctctatatcatcatcaccgtaatgatgatcataatctaattcccccgtcacaaatccagtccttacagcagcatcctcgtcagatgacatattaaataatattttgccgtcttttacggaaatgtgagtgtaaatggtcagactctcttgcaaaagcatggccggtcttgcaaagatcacgttttttaaacgagtgacctctttctttcgatatgaccgcgttcccgctgcgcatgccatttcaagaaaagcagctgccgggagaatgctcttgttttttacgatgtggtcttttaaccaaatctctttttctcttaatgtcgttttaaaaaactgctgttccagagtagattcattcgaatccagaagcgggtgcagtgaagactgctgcggcaatatttccggaaatattgcgctttgatttcgaggcacccagtaagactcctcagcaaatggatataaaggaagcttgaccttttgcggggtatactcttcatataactctctccattgaatatcagccccgaaagaccataattttgctagaagattcaagtcctttgtctccatcatcacttcgaggaatttatctttcatcttttgatcatgaaagataaagactttatcaaaatcttttgtaacattgcctttgtatacgccctctccaattgttccttcagtacagaaagttctcagcttctccttaagttccggcaaatcggaagctacaacagcaagtctgtcttccataggctccctgcatgtctgcaatgtaaaagcgatatcagctgccgaggctgttgtctcccgctctgtgaattgcagaaggcgccgggcgtattctttcagtctgtcttcatttttggcagaaagaactgcggcaaacggaccgcttattgtttgtgtgtccgcatggttttgatattcctccacaatgacatgggcatttgctcctcccgctccgaacgaactgattgctgctctcctgttagaggcgcctgattctttccgccactcttcttctttctgctgaacgtaaaaaggcgtcttttcaaatcggatattttggttcagctgttccgagtgaatggatggcgccaacttctgatgcttaaattgtaaaagaacttttgtaagggctgctatacctgcggcagactccaaatgtccgatattagacttcactgaacctatggcacaaaattgtttatcatccgtaaatttctcaaaagcttttgtcaatcctgcgatctcaatcggatctccgagcgaggtacccgttccgtgtgcttccaagtagctgacggatcgcggactgatgcccgatttcttgaaattttcagcaatcagctcagcttgtgcattcggattcggaaccgtaaatccattggtttttccgccatgatttacagatgttcctttaatcactccgtatatatgatcctgatcagcaattgctttttccagaggtttcaacagaacggctcccgaaccttctcccgggacatagccgtctccgccctctccgaaacttctgcacaatccttcggtggaaacaaaattaccttgactcagccaaaggtatttgctggggtgtatggatacattaacgccgcctgcaagcgcaatttcactttcccctcttttaatgctctcacatgccaagtgaatggccgtcagcgatgatgaacacatcgtatccagtgcaatgctcgggccggagagattaaaaaagtacgaaaccctgttggcaatagatgaaaagaaggaactgagcgcaatcggattgccccgcgcagtttcttctgcgccgaataattgatattgtccgtacatggctccgacaaatacaccggctttcataccgttaagcttctcttttgtatatcctgaatcttcaaacgtatgccaggaggtttcgagaaaaattcgctcctgagggtccatcagctcagcttctttatgagaaatgtggaaaaacagcggatcgaattgatcaacaccgctgataaaaccgccccacttactgttgattttccccttctccattctgtcgggactgtaattcgatctgaaatcccaacgttcctcggggatttcaataatacagtttttccctccggcaatgttttcccagaactcctcaagagtatcggaattcggatatcttccgctcacaccgataatggcaatatcctcccccggctgatccatgctcggtgcaggtgtatccttctgctgccggtgctgttttttactcggattttctcttttcttctgtactcttgttaccggagctgcccctgcggccttaagcactttttctttaaaagatgttaggaagaagtttgaaagctcttcaatgttctgatattcaaaaaagattgttttcggaagatccccgaaagtatcttcaagctttgcaataagtgacatgatcataagtgagttgattccgaacttctcaaaagagtctttcgcatttattttatgagcttggattttcaagacaccgctgatgatcttgattaaatagtcattgactttttctttcgcagcatattccgcttcttcatcgtgttccgccgtgagtgtatcttgatctgctgcagctgtatttctttgaatcgaaagcgcctttatcattttatcccgctcaccttctgcaggcattaagctggtaaatgaagaccgcagcattttcagaaacgcttccagaacagaggaagttcgcatcggagtcattccgtatttttcttttatttgaacgattccactgctgtcgagactcattccgccatctttcaataacggccaattgattgatagtgtttttccgtttcgagagagctgggatcgaagcattgcaaaactgtccataaaatgatttgcgtacgcatagtcactttggccggcatttccgtaagcggaaaaagaagaaaagagaacaaaaaaatcaagatcttcgtcttttgtcagctcatccagccagattgtcccgtaaactttcggtttcagtacgtccgtaaaatcaccgggacttttatttacaagaaatgaatcacgaaggatgccggcagcatggatgatcccgtttatgctgccgtaccgctgtttaatgccgaaaatgaatcgctctgcctctgttcgatctgttatgtccgtccgctgatattcaacaatagagccgctctcattaagcatactgatccgttctttttgatcagctgttaaaaaagaacggcctgtaagtataatcacggcttgattttcattagcgatgtgttccgcaaacagcagcccgagttttccggctcctccggtaatgatatatatgccgcctttttgatacgttacagatccgttatcgtgttccggaatatcaataggctgcagccctttcacataacgggtatatgagtctattaaaatctcacattcatccgtttgaatgcgctgcatttcactgattgcagcatcccacatctcggaaaccggaggatttatgtcagaatcctcgtggcgtatctgtatggttttcgctttaagcttggagctttccatgtttaccgttttcacgaaccctccgacagcttcatgaaacggctgattcagaccgcttgtccaataaatatgcaataacgtaacaggttcgtttcttcgcattaaagcttttgataataaaaagagcgagtttatccctctgcgaagagattcattaacagattcttcagtgaattctctgatttctctattccataaataaagcacgacatcaggtgtaaatccgttttcagccaaatcagacagcagcatttcgacatgatgttcatcagaaggattgattgtgcatctattccgttcaattctgtaatcagaatcgggcgttacaagaatgacacggttatgttctccattcatcatctcggcatgctgaaaaagacggttatcctgatcaaaaatcagcatattccccggtgcctgctgattcggcatatcaatgtgatttgtcctgacccaatcggtcttaaaaaaaatggttggggacggagcttgtgattccggctccgcctttttttccatttgttgttttctgtaagtacgaattagctccagtcctgcatcaggagacatttgctgttcttcaattaaggaaagtatttgtttgatctgcactattttccctccagcagctgataaacttggtcagcagaaagttcaccgtttttcaattgttccaataagaagagaatttcctgatcttcatttttatgacctgcggttaattctcccccggtcacttttctgacagagaagtctttcatgctcacggctacttcgccgctctcgttaataaaatcaatgttatacgtataaaaaccggtttctctcaccgaaacatggcatcgggcagtaagcgccctcttaatgtgaagctctctaagtgaataaggaacaaataagccgtctttctcattttctcttaacaaaaatgcagccgcttgaaaaccgccgtcaattaatgaaggatggagtgtaaaatgtgaaaacccgttcgctaaatgatccggaagctccaattctgccattaactccacatcaccgcgatatacggctttcaacgtttgaaaaccgctctgatatgtcaggcccatacgactgaagcggtgataacactctttccggcttatgaccgttttactgctgcgtatgaactgatcaatatcgacatactcaggattgctgtttatgtctccgaatactgtttcacattgtgtgcagatttgctgcacgccatccgggccctctttacatatcgttgcgttcaacttatcttgtttcatttccaagccggtataaatgtgcagcgtttttcctttatataatataggtctgttccacatcacgtcttttattttatatactttactttctccgcttatttccgcacaaactagagccatttcaagcgaagcggctcccggcaacacacagtctcctgaaacaaggtgatcagtgacgaaaaattcagttccggaaataacagttttaaatgcttgtttctttaatgttgagacattctcgctgattaatgggtgaagacttttgctattaacctcgcctttgttctttttcggagtaaaccaataactctcttttgcaaacggataagacggcagcggcactctattcaatttctcattgccgatggtcttccattcaaactcggctccattggcccaccattgtgcgagcagctcctcctttccgctttgaagagcctcctgaatcatatattcagaaacagctgcacgctcttcagtgttttcgcttataaatacgccattttgcaccttgcttttatcaagaaagctgacgtatttatctctcagctcagtcagactcactgcacatacggcaattctctcgttcattgcttcccggccgttttgcaatgtaaattccatgtcactggcattaacggtcatgtcaccggcaatcacgcgatccaagtactgaaccataagccggatatactcaagtaattgatctttggttttcgcagataaaacaaaaatgtgtgttttaccgttgttttccggtacttctttttgaggttccctatattcctctaaaacaatatgtgcgttcacaccgccgaatccgaatgagctgacacctgctctcctcggcagatcgttgttctcttcatcttttatcggattccacttttgagcggtttctgtgatataaaatggcgtattttccattttgatgtatggattgagttctgaaaaatgggcgagtcccggaagtttgcgatatttaaaagccagtaacactttcagcactccggctattccggcagcggtttcgagatggccgatgtttgttttcacagacccgattccgcagcttttctgtttctcaaaaggaatgtcccattcttgatataacgttttaaatgcctttatgatgctgtttacttcaatcggatcgccaagacttgtccctgtgccatgcgcttctatatatcccgcagtggcgggactgacccccgccttccgccaagcttcggttaataagtccgcctgtgcgttcggattcggagctgtcaaagaattggcgcggccgccgtgatttacagctgaccctttaatcaaaccataaatatgatcaccgtctgcctgtgctttgctgagcggcttaagcagtactgcagccgccccttcactccttacatagccgtcagcgcttttatcaaacgttttgcactttccgtctttggaaagcatacctgctttatcaaaagctataaacagagtagggcttgtcataatatgcactccgcctgcaatcgccatttcaaaatcgcctctttgaatcccctcagccgcacgatggagtgcaactaatgaacttgaacaggcagtgtcaatcggttcgctcggacccgtcaggttcagctggtaagaaatacgattagccaatatacaatgatttaaaccggttgcggtctgcgcctgaacagagacgccattttcattgagacgttccgcatagtccgttgtggcgacccctgcaaacaccgcggttttcgtccctgccagatctgacggcttatagcccgcatcttctattgttttccatacagtctccataaaaattctttgctggggatccattaattctgcttcggcgggagaaatcccgaaaaacaacggatcaaaactgtccgcgcctttgataaatccgcctttttttatttttgttctattgacgtccctgatcggatcgccgtcaaactctttccagtcccaacggtcttcaggaatgtctgtaatcatatcccgccctttttcaattccttcccaaaagtcttccagcgtatctgtttgggggaaacggccgcttattcccactattgcaaccggctcattcatatgtctttcctcttgcctggttttgttttcaggctcaggggaatgttcataggattccggcggaggcgtgctgtacaatgttttttcgtctgctgcagaaaaaggttctgtctcagcaaaaaggatttctccgtattgctcgattacataatcagtcagttcagccagtgaattgcattcaaagaaaatggacggcaataattccgtaccatattgttgattgatttcatttccgagtctggtaaacgtaatagaatcaaatccgtactcgccgaatgaagtctcttcttccatttcctttctgtcaatctttaaaatactggacatcatctttgcgatgccctcaatcagattttctctcctgtctttcgccgcagattcatctgaagaaaaagatccgcagagatgaagctcttcggaatactcactctttaaaaactcaagaagttcattaaaatcagtaagaccgaaaaaatctgacggcatcattgatattcctaatgtttcgtttaattcgttgcccagcattgtaaacataattgaatcaaatccgtattcacttatcggcagttcaaaatcaaattcccgttcttcaatttttaatacgccggtgatgatgcgcgtcaaagtgctttttaaagattcagttattgacagctctttcggttcgtgattttcgtcggcgattgccgggtcactttttccgctgtcaatcgttatcattcgttccagctttaattcattaccgctaaataccattatttgatgttcacaccctgtcattgcttgatcaaatgctgcaaggccttcccgttttcccagaggcagcattccgaaacggtcataaaggaacttctctgaatgaatgtcaatttgcataccgccttctttccataaaggccaattaatcgagactgtttttccaggtttattttccgccgctctcatttccgcaaagtaatccataaaccggtttgcataagcataatcagtttgtccggcattcccgattattgcgctgatagatgaaaacataacaaaaaagtccagaggttctctgtctgtataccggtcaagccatatcgttccgtaaaccttgctggccaggactgaatcgagatcctcttcacgcttattgatgagtaatgaatcttttatcacaccggcgctgtgaataactcctttaacaggacctaatttgtttttgacgagttttatcaggttgttgacattttccttatcagaaatatcggtttttacataaaaaacttctgatccgtttttttcgagctcttttacattgcttacggcttcctcagaaagctctgacctgccgataagcacaagctttattctcccttttcgcacaagatgtctggcaaaaatcaggcccaggccgcctgttcctcctgtaataaggtaaactcccccttcttttacttccatctttttgggggctctgccctttcaatttctgcagagtgtttcacctgcctgattccatctctgtatctgatctctgaagcatcatcgctgatgactgtttctttcacaaggttttttaattcaggcagaccggtgttcagctgtaactgaatttcatcgctgtgtatttcaatatttttaccggacaacattggatgttctaaatgaagcgacctaaaaaagccgctgattgccatttgataaggtaagatttgattgttccttgtgaaaaatacatgtgatatcagaattttatgtcttgggattgttgctaacagagctttcgttacattgaaaaccggcaaaacagcctcttccagcttttcatgaatgttatgctcaattcccgtttcagggctcatcccgattaaaatgacgcggtcaattgtcacttgtctttctttaagaatcgccagcaatttcttatagccttcaagtttgacgctgttcaattcaaaggaatcagcttctttttcttgaaaacttccgccatggcggacaaagatcatgttcaggccgatatctttatatgcctggcggatcagcggttctgatatatcctgacggagtgaaattacaaggcagctgtttaaaccgctgccttcaggctgatgaagcataggggcccgcttccacatatcagagtaatacttagctgaatgccgctcattttgagtctgcggtgcagcccttaatgccttcaacgctaagttttttattttaagacttacagatccgtgttcatccataaatagtatatgaaaccttttgacatcatcatgttgtctttcatcggcagctgtaatgtaagcatagccgcttgccgaaggtggttgaagaatttccagctcacctaattcaaaaggcaaatatgcggtatgatcgtcttcctgaccggacgtaaacccgattgtggattgaaaaatgccatccaataaacacggttccagcagcccgccggattttttatcaatgctctcaggaagtgatattcgtgcaagaacagcattttcatggataagcagctgttttattacctgaaagccggctccatagtccaaaccgctctgccggaagtttctataacactcagcgccgctgattaatcttttctgtccggttaaccagctgtccaatttaaaatgctctgtatgagaggcgtctttatctccgcatgtcataatgtttccttggcaatgaactgccgcttcagattgcatatcggttttcaccacaaatctgccgtctttttgattcggcagcagatctatcattatcgtcttttctttttcaacggttatcggaaccgcccatacaacctgactcagttttatgactgattttccgtacagcctctctcccgcttctctggccgcttcgatgattgccgctccgggcagaaccatattcccatgcacaacatggtcttttaaataatattcagaatctgaaagcgttttataaaatcggcactcaccggcagaaaaatcaaataaaggagctgtaccggctgctgatgttgtttgcgccttatttgacacccacagtctgttttttaagaaagggtaagtcggcagcgcaatttttgccggttttctgccggtgcggaaatcttcccagcttaaactccctcccgatacccagaattcagccatgtcggctaatgtggttctgccggaattgagcggaagatccgattgccgctgtccgcgtttatgattcggttttttccctctgaatatttcgtgatcgtcaattccattataaaagtgatttaatttcaacatcaggtcatcgatatttttcgaaatgacagcaagcctttccggcatggcttcccgcccttcaagaagggtatatgcaatatcagaaaggtgaagcggcttatttgttcccgccggctgtaaacactcgccctgcttatgacgagccttttgaagatattcctccagcttttttgctgattcccgtaaactcagtgaatgcttggctgagagtacgataagttcttcactttcctcacgccccgtttgacagtcagcagcagactcatactcttccacaagaatatgagcatttgccccgcccgctccgaaagaacttaatcccgcacgccgcggatatttgctgtcagaatgtttttcattcgcgggttttatccagtcggcagtttcctgctggagacaaaaaggtgtctcttccagataaagatccggatgcacccgttcagcatgcagtgttgcggctatttttttatacttcatttgtaaaataatctttgtcaggccggcaatacccgcggccgcttcgagatgaccgatgttagatttaatcgatccgagagagcaatatgaaacatcttcggtataagctctgaacgccttggtcagacctcggacttcaatcgggtcacccagcggcgttcccgtgccgtgtgcttcaataaagctgacacttctggcgctccaaccggccgctttaagagctccttgaattaaatccgcctgtgcggcaggattaggcaccgtatagccattcgtctttccgccatggttaattgccgttccttttatgacggcgtacacagtatcattatcacgtatggcatctttaagcggtttaagaataacggccccgacaccttctccgggcacgaaaccgtcgccgccttctccaaaacttctgcattttcccgattttgaaagcattcccatctgacaccggtataaatagtcagaaggatgaagatacaaatttactcctcccgcaaccgcaaccgagcactcacctttttttaaactttggcaagccatgtgaattgccgttaaggatgaagagcaagccgtatctacagggatactgggacccgtaaaatcaaatgtgtaagacactctgttcgcgagagaccacgggaacgaatttggaagtacatcgtttttgtccgtcggtattctttcgccgagcagcttgtaagaattggttgtaactcccgcaaatacaccgacatgtttttcggtctgctttctcaacccttcaatggtatatcccgaatcttcaaatgctttccatacggtttcgagaaatattcgttcctgaggatccatcgcttctgcttctctcggcgatatttggaaaaacaaagaatcaaatgattcagcattctttaaaaatccgccccatttgcaataaattttcccctcatgcgctttagcgggatctggatcatagtaggtctcataattccatcgttctttcggaatttctgtgattgaggttctctcttttgatagaagatcccacaattcttcgatattttcagccccgggataacggccgctgataccgattaccgctatcccgtcaagatgttctttttcctccgccgcagatgcagtggtgttttgttccggcctggcgggggtaatgctctgaatctgttttcctttttcctcccgtgaaaataaacgtcccagccgatccgggtattcttttacaagatgatctgctaaatctctgattgtatgaaattcaaataaaagcgttttcgaaattgctcccagtgactgctccagctttgtgttgcattgatgaatcataacggaatccattccatattcagccagatgcacatcttgatcgatctcttcccgttctgcaccgacctcacaggagatgatattggttaaaaacaaaactgtctgatccaaaatatcgccttgagccaaaggaacggcactgcctgtctctgtttcgtccgtcaaaaatctctgctgcataaattgttcaaagcgttcatgatcaccgcagactgcaatattatgcagctgacccgaagttacaatccgcgaaaaccattgcgttccgtcttcagcaggaagttcttcgagccctgaaccatgaaaaagagacgtccgcccttgacctgacaggttcgcccccattccgatgtcttgccataaaggccaattgattgtcagggtgcggccgctgcgcagagaattttgccgtttctgttcccgatattcggcaaaatgatctaaaaagccgtttgcatatgcataatcacactgaccttcgttgcctgcaatagagacgactgaagaaaaaacggcgaaaaaatctaattcgagcgacttcgttgcatgatcaagattcaatgcgccatgaactttcggagcaatcacctctgaaagttcatgctttgtttttcgaaaaagcagcgagtctctgataactcctgcacaatgaatgacgccatgaagacctgcatgctgatcggtaataccgtcaatcattttttttaccgcttctttatcggatatattcgcctgtatataataaaccttggctttaaagctgttcaggtattctaaatgtttctgcttatctccgtttaaaacagatcgccccgataggataatggtggatctttcagttttcgcgcaatattcagcgattttactgccaatccccccaaatccccctgtaattaaatatactttatctttttcagggtattgaatggtctttctgtttgtttctctctgcttctctaacatccgtgcatatcttacgcagcctctgtaagtgatatgaatatgccgatcaggcgctgtgtttatttctttataaagaatgtcagccttctctgaacatgaaacggatgcagaatcatgttcaaagcaaaccgtcttacaatgcagctgcgggtactcttgttttaccgattttaaaaaaccgttcacaccttcaaaatacggcaatttttctttttgatctgcgctgaatgtataaatgaacgttactttgtttataaggttctcgctgattaaagccttagtcagataaaacacagaataaattcctgatgcgagtgtttcttccagttcaggctgtttttcagaccaagtatgcaaaattgcatcgggcgctgcgcctttttcctttaacagacgaatgacaccttgataatcttcgggacactgcctgttgatggtgaaaacactgtcgcttatctgctctaaacggtcaccgggcataataagatatgcggacgtattctctctttttttcagctcttcaaaatagtctttattcccggagaacaacaaaatagtacaggcttgtccgctgcccgcttcattctcaagtgcggtttctttccataccggcgtataaagtgcctgattcttcttttctgaaaaagccgcgtctgattttaccggctgagggtttaaagaaaattgagagcgctcaaacggataaggcggaagcggggcttttcttttatgataatcacctagtttcgcccattcaatctcttctcctgaaagccacatttgcataaatgaatgataaagagcctcatcagctggtttgtccgcttcaaaagcagccgctttgtttagttttgctgatggagggagcgatccgaattgaaaaactgaaaaatcagagatattcacatccggctccgttcccttttcttccgtgtgaagcggcatatggtcagctatctcctgaaacacggcatccatctgattgtattctgtcatcagcggaaaacgggccttatcataaaaacctgccggctgctcattcatacaagcaacagcctgtttaattccgtcttgctttttcaataacatgctcagaaaaagttctttagacaagattccttcatccagtaaatttaatatttccagaacataatcattatcaaagaatccatcataatctgttaaatcccatctcttatacagtcttctcatagaggcaaggatagccatgatcgccgcttcctcttcagccggcaatgcgtttcttttatccgccgtgcgattcacaatataagataaaatctcgatttcctgagtctttcccgctttatcccactcttctaaaaaccctttaaacgtatattggtgctcaagaagcagccgtgttttcccgtacaggcggtctgtaaaatcagccgggaagctcagaccgttcagcagcatccttacatattcttcatttaatcgaaccggcgggtacgtttttgaagtgtacggattgacaaatggaatggacggcggctcgcaggataagtgcgaaggtttttcagcgcctgtgatgacagaaatggccttttcaattttgatgatatccgctgctgcaagagcgacgtaatatccgtctccggcgcctgtaatgagacttggcttaaaaccggatgccaggatactttttatgatttccgtattgataactaaagaatacaagcggattttctcaggcgtccattttcttttaaatgaactgtgcaatgctggtatacccttcagcaccgaccttacgttcttttctagatcagggaacacgcgtttcaaaacggcaaattgtttataactttcccatttgaagtcaccgatggcaagcgcccattcagaatcatgtttcctccgaaaacttaatccctctttaagctgatttttaaattcctccttgctgcctgccaataaacccgccctgtaatcaaacgatgtccttgttaaaagggtgctgctgatcgcttcatttgatattttgcaaaattcctcagaatcgtcagaaaaggttctccaattatgtatcatttgtttcatgctttcttcacttttagcggaaaaaaggaagggagcccttacctttctgtcagtttcgtcatttgtatgtataaattcttcgatgatgacgtgagagttaacacccccaaaaccgaaggagctgattcccgccctgagcggagccccgtctgccgccttccaatcacttgaatcaagcgccggcctaaacggtgttttttcaaactgtataattggatttaccgtatgtacattcaggcttttcggcaccctccgatgtttcatcatcattagaacttttatcaatccggccattcccgccgctgcttctgtatgaccgatatttgttttcacacttccgattctgcaatattgagtatcctcagtatattgccgatatgcttttgtcaatgcttctatttctatcggatcgcccagagatgtacctgtaccatgtgcttctacataagaaaccgtcgcagcatcaacagcagcgttgtgtaaagcttctgagatgacccggcactgcgcttctgctctgggagcggttatggaacgggatttaccgccatgattaacagccgtcccttttatgatcccgtatatatggtgaccggcttttactgcatcaccaaggcgctgcagcaatacaacgcctgccccttctccgggaacgtacccgttcgccgctgcgtcaaaggttttacatttgccgtcaggactcagcattctggctttagaaaaagaaatatattttccgggttggaaattcaagtttactcccgatgcaattgcataatcgctttcttttgtccgcaatgacttaaccgcttcatgtaaagcaacaagcgacgatgcacaagcggcatttacagacatgctttttccggtcaaaccgaatgtgtatgaaagccggttggagagcatagcttcgaaacttcctaaacaggcgtaactgtcgatttccgattcatgacctgtctgccggtagtcagaattcataatacccgcaaaaacagaagtggttttacgctggagatcccgcaaagagaccccggaatcttcgatgcaccgccaagtttcttctaaaaggattctttgctcaggatccatgtttttcgcttcccggggagagatattaaaaaacttatggtcgaaatggtcagctttatgaataaaacctccccacttgctgattgttttgttcggtatactgatatcagctgagtaataaagatcgggatcccaccgttcaatcggcacttcccggatggaatctttgccgctatttatgttttcccagaattcatgataatgatctgcatcggggaatctgcaagcaaccccgattatcgcgatatccgcactctgtttattcaaatgaaccattggcctccacccgcccctttttagtgtagaaataacgtatccaatctgcgtcttagcagactttcggtctcattcatcattttttcaccaatgtcatcgacatgtctgtttctccatgattccaactccgtgccctttacccaatggttaaaagcgcctaaagacgggccgcaatgaacttggaaattcaccttttgttcttcctccccttccaaagcaagcagacatcctctctgcaaataccacttaaatagtaacagcatcttatatttttgattgcgctccgctttttgggccaggttcggctgtttttctattatgctttcgtagatttcatcaaaagtcttattaaaataaacattttcgagctgaatctttgtctcttcatctatctcactcaaagactcatattgttggtagatttgaaataatttatttgccctgaccggaaacagcgtgccctttttcagcacctgaacctttgttccgaactcaaacagagtctccgaaggcgcataagcagtatcgcatatttctgtctcactcagcatttctttaacaaaaccgcttgttgcggcttcaactgtacattgattaatggatcccgtcataataaaatcagcgcccattaaaaaagcagacgccgcagactcgggagttccgattcctcccgcggccccgactctgatcttccttgcgtatttatgtgtttccatcatttcatcccgcaggttaacaaaaaacggcagcatcgccgtcaatgagccctgttcggtattactgccgcaatctgcttcaataatgatatcgtctgctgacggaacacggctgagccactccgcctgctcttccgtcagcataccgtgctgacacattctctttacgatactttggggaggcggactcagaaatgcggccgcaacttccggccgtgaaactttggcaatgatccgattatgaggtatgaccctgccgcttttgtccatcttcaactgatgcgctttgtaataaattaatggcgcgctgacggaaagatacgaagacgcttctattacccgtacgtcatgcttgatatataaatctatcaattccttttctctatcttgatgatccggctcaaatcgcagattcattccgtagggctggccatttttgagtgtctccttaatagaaataagggcctgttcaatttcccttatagttaaacccgctgtgccaaagaaccccagcattcctttcttcccgaggcggatcagcatttcagcggaagagatccctctatgcatcgcacctgccaaatacgcgtatgtcaaaccgtaatcttctttgaaagattgatcacccaatcgggacaccggtgaagccgcaacgctttctatattttcggccatgaggcccttctctttcccgctttcggaattgtccttgttcccttcagaaaacaagagactgtcttttggcgcactaatattaagcggttcctcatctctttgtatggtttgaattaatttagtcagaatgtttccgggaccgatctcttcaaacacagtgacgccttgtcccattaagtacctgatgctttcagtccatttcaccgagtttgttatttgttcaattaaattccgtttgatatcttcttgtttataaggtcttgccgtatagttagagatgaccgggaaattcaattcagaaaaatgaaactccccgataaattccgcaaattcacgctgtgcactttccatgaaacgagaatgaaaagctccgccgacttgcaatacgatataagctttcgccccttctttttcaaaaaaagaggctgcacgctttatctcttctgcagcccctgctatcacaatttgtgaagatgtattgtaattggcgatatctatttggccgaattcatacttttgaagtatttttttatgtgatgctcatccagtccgatcacggcagccattccgccctcggaagcctcactcattaactcgcctcttttagcaaccagccggagacctgtttcaaaattaaaaacaccggccgcaaaaagcgcagtatattcacccagactatgtcctgcaacagcatcagggcgagtatgaccttcttttaaaccctttaaatattgcagtgcgctcactgtataaattgcaggttgtgtatacttcgtatcagtgagcctctctttttcatctgaaaggcataaatcctttatggagtatcctaaaatatgatctgcctttttaatgagctcactgaattcatcgaataagtctctgcccattcctttaaactgcgctccctgtccgggaaagacgtaagcaagcatttgttttcctccttgttccgtatttctgccgtttcttttcgttccgattgtgatttgtttaacatttttcacttcaatttttaaaattgtcatttactctaagcacccggcaccattacttaataagcattacgaagcaaaataaaaaaacctttatgccggataaaggtttaaaagcaaaaagcatgtacaaagatcatattgccgcaaataatagatagaattttctgataattaaaaccgcattttcattctgttttttatatatcaatataataaaaacatcccaacgtgccgaaacaacgattggttttatgtgaatatttccctaaataaatactataccatgatttacatgttgtcaatgggaaacacacgtatataccaattcttcagccgccatttacaggcggctgaactcggttgttatcagttcatcagcccatgccgatatgccttcactatactattcgcggaataatagttctttctctttgttgtagtctttagtaaattgattgaactcatctgcttgtttatgcactttttcgtaaactgagtttactttgccgatttgctcttccagctgcgataatgtgagctttttatctttaatcagtttataaaggtcctgatcaagtgaaatggctttttcgtactttttgtacaaaagatcataagatgcataccttttttccattaaagcgacagcatgcccggctttttcttttactttcttatcctttatttcttgagaagttttttttgcggattcaaatgctttttttgaatcatcaatactgtctttttctgctttcagatgtttttttcgctgatttgcattgctcagagcctgatcagacagtgtgacgattttcttgtaatcatccatattcagtttaaccgcgctgtcgtaaagcttgtgctcttttttctccaatttttccaatgttttctgctctttttgaaacggtttttccgcttgaacggctttttccatcgagtcatgaagcgattcaaccggatcttttcccccgcagcccgcaagcagcatacttgcggcgccgagcgctccgattcctgctaatacctttttttgaatcatattcacttaaaatcccccaatcttgacaatttccactatagaagcccgaacgctttttgacaatagctgagctgtaattggcatgaccgggtaaaaagatgcttacggtgctgtcaaagaatacttgcgtaaaaaattgagaaaacagggcggatgaccatacatctttttggcttttacatagtttatagtagacgccggccctgctgacaaagggtcagcgtaattaaaagaggaggtttttttatgtacggatatggatttggcggcggatttggcggcggatttggcggcggttgctgcggcggatacggttatggcggttacggttatggctgcggcggcggatatggccgcacattcgcattaatcgtcgtattgtttatcttattaatcatcgtcggtgccgcttatttaggctgcggctgctgaccttatacaccatgaaaatcggccggcctgctatggccggccaattgtttcgttgcgccgcgataaagaaattcgctataatttacatattaagctttaggagtgaagtttcttgattactatggaaaatattgtacgcgacggacatcccgcgctcagagagatcgctgaagaggttcagcttcccgcttccgacgaagaaaaacagcatcttgctgatatgattgagtttgtgaaaaacagccaaaatcctgaattagccgagaaatacaagcttcgtccgggcgtcggtcttgccgctccgcaaacagacgtaaaaaaacggatgatcgccgtccatgcagaagatgcgaaaggcactttatacagctatgctctttttaaccctaaaatcgtcagccactcagtggaaaaaagctacttgacgagcggagaaggctgcctgtcggtagacgaacccattcccggctatgtgccgcgctacgcccgcatccgcgtaaaggcggtgacgcttgaaggagaacagattgacatccgcctcaaaggttttccggccatcgtgtttcagcacgaaatcgatcatctgaacggcgtgatgttttacgatcatatcgataaagaaaatccgttcaaagaacctgaaaacgccattgccattgaccgttaaaaaaaccggcacttcccaaagtgccggttttctttatttcaaaaggcccagttctttgacggcccagctgattccctcttcatccaccggctttgtgacgaaatcggcggcagcttttaattccggaaccgcatttcccatcgccaccccggtgccggcaaaacggatcatctcaaggtcatttagtccgtcgccgaatgcataagtgtcacttacgccgtacggaagccgctcaagcactcttttaatgccttccgcttttgaaccgcctttcggaagcacatccgttgacaattcatgccagcggacgtaatcaaactccggaaaagcggcatatgctttttcttcatgtccgcggcagaataaaagcagctgataaatttcttttcctttataaaatgtttcatcaacttcgggataaggcgctttcagactgccgataccttccgagacgtgcggatgtccggggacggtcgttttcatcgtgtcttccgccataaatacgacggggtgctccccttctgccgcctgctttaataaacgcgcaaccgcatcttcaggaagcggatttttataaatgacctcaccttcaaatacgacatactggccgttgtatgaaataaatgattcaatctcaagctcttccagaatcggttttaccataaacggggaccttccgctggcgataaaaacgtgatgtccagcctctttaagcgccgtcacggcgtttcttgcgctatcgggaatatgtttatcatggtcatagatcgtgccgtcaatatcaaaaaagatcagttttggtttcatgtcaatttctcctttttcccgtttatcagtcgtgtctttttcaatatcatcatacagaaagtttttcttccggaaaaccgccttgatgaaattccagttttacccacgaaaacaaattcattttttccgcatactactgctataaagggctttaaaggaggtatacgatgctgcgccgattacggaagaaactcagaagacagtggggcggaatgctccggaaaaaagtcatcgcatagaagggatctttcggtttttgaaagtcccttttttgctcgagactttccttataatccgttttcgaatataatagaatcagcgagtctaacatacggcatttaaggagagatttggatgatttataaggtattttatcaagagaaggctgacgaagtacctgttcgggaaaaaacagattcactttacattgagggcgtttcagaacgggacgtcagaacgaaactgaaagatcagaaatacaacattgaatttgttcagcctgtggacggtgcttttttagaatatgagaagcagagcgaaaattttaaagtattggagttatgagcggaatgaaatttgtaaaaaatgaccagactgccgttttcgccctcggcggattgggcgagatcgggaaaaatacgtacggggtgcagtttcaggatgaaattgtactgattgatgcgggaatcaagttcccggaagatgaacttctcggcattgattacgtaatccccgattacacgtatttagtaaaaaatgaagataaaattaaaggtctgtttatcacccacggtcatgaagaccatatcggcggtattccgtacctgctcagacaagtaaatattcccgtttacggcggtaaactcgcgatcggcttacttcggaataaacttgaagagcacgggctgttaagacagaccaaattaaacatcatcggtgaagacgacatcgtgaagttccgcaagacgtctgtatccttcttcagaacgacacacagcattccggattcatacggaatcgtcgtcaaaacaccgccgggcaatatcgtacataccggggactttaagttcgatttcacaccggtaggcgaaccggccaacttgacaaagatggctgaaatcgggaaagaaggcgttttgtgcctgctttctgacagtacaaacagtgaggtgcctgatttcaccatgtcagaacgccgcgtaggcgaaagcattcacgatattttccgaaaagtggacggcagaattatatttgcgacattcgcttcgaatatacaccgtcttcagcaggtgattgaagcagccgttttaaacggcagaaaagttgccgtattcggacgcagtatggaatcggctattgaaatcggacaaaatctcggttacattacctgtcctaaaaatacgtttattgagcataacgaaatcaatcgtatgcctgccaataaggtaacgattttatgtacggggagccaaggtgaaccgatggcggcgttatcacgcatcgctaacgggacgcaccggcagatttccattaatcccggagatacggtcgtcttttcttcctctccgatacccggaaacacaatcagcgtaagccgcaccatcaaccagctgtaccgtgcgggcgcagaagtcattcacggttcattgaatgacattcatacatccggacacggcggacaggaagagcagaaattaatgctccgcctgatcaaaccgaagttctttatgccgattcacggtgagtacagaatgcagaaaatgcacgtcaaactcgcgactgattgcggcatacctgaagaaaactgttttatcatggataatggcgaagtgctggccctcaaaggcgaagaagccgctgtggcaggcaaaattccgtcaggctccgtttacattgacggaagcggaatcggtgatatcggcaatatcgtgctccgcgaccgtcgcattctttcagaagaaggccttgttatcgttgttgtcagcatcaatatggacgactttaaggtttcggcgggacctgatttaatctcaagaggttttgtatatatgagagaatccggtgatttgatcaatgacgcgcagcagctcatttcaaaccatctggagaaagtaatggatcggaaaacaacgcagtggtccgaaattaaaaacgaaattaccgatacgcttgctccgttcctatacgaaaaaacaaaacgccgcccgatgatccttccgatcattatggaggtctaaaaaaactgcactcattacgagtgcagtttttttattgcagcggaatatgctgaaaggctttgacatcaaacagaccggccgccgtcattttaatatccggaatcaccggaagggctaaaaacgataaggtgagaaacggattgaaatcaccggtgaatccaagcagaggaagcttttcatgaagcacgcccaagctgtcattaacccattccgccgacttatcagacaaaagcccggcgatcggaagcggaacggagtgaagcaattctccgtttttcacggctgttaatccgcccccggtgtcacggagcttgttgattgcttttgccaaatcggcatcgtttgtaccgacggcgatgatattatgggaatcgtgagaaatggttgtggcgatggcgccttcttttaacccgaacccttgtacaatcccgagtcctatcattttttcgccgctgtgccgctctgcgacggcgatttttaataaatcattatctgtatcaggtcgaaacgcgtcagcagacggtgcaggcacttctttttttctcgtctccaaatgattcggtatcatttcgattacattcattttcctgccctcttgaatcggtatatgaaaatccgattcagtcagcggcgctttcagccgcactgtatccaacagtgcctggtccggcgaataggaaccggcagactgttcataaaccgtccgtccgttctcggcaacggtccggccggcgaccatggtcttcgtgacggcagcctcccgtacatctgaaatgaacagcagatctgcgtcaaaacccggcgctaccgccccttttgtttcaaggccgtagcactcagccgcatttaagctggcgagctgatacgcaaggaatggatcaagtcccgcctttatcgccattttgacttggtggttcacacttccttctgtaagcagatcatctacatgcttatcatccgtacaaaagaaaaagcggcgcgcgtttttttcattcaccgccggcagcacgttgagcgtattttttgccaccgatccttcgcgcagcatgacgtacattccccgtctgattctgtccagcgcttcttcttttgtcgtcacttcatgatcatttgacaccattgcggttctgtatatattgatgatatctgaagacagtccggctaaatgcccgtcgatccgctttccgtgacgcttggcatcaagcagtttctgaagcatatcctcttcaccttccgcaacagacacataatccattacttccgcaagcccgagcacctctttctcctgataaaaaggctttaaatcctcggcttttaatacagctcctgagcgttcaaagctagcggcgggaacacaggaaggaagcatgaaacggatgttcagcggcgcctttttcgcctgctctatcataaatgaaatgccttttgctccggaaacgttcgcaatttcgtgaggatcagtaatgacagtagtcactccgtgagggaggacggctttagcaaattcaatcggagtaaccatagaggactcgatatgaacatgtccgtcaataaagcccggaacgatcatttggccttctgcatcaatgacttcttccccttcatattcgcccagcccgacgatcactccgcccgtaatggcgatatctgcagaaatccattcctggttaaatacatccatgatttttccgtttttaatgacggtatcggctttttgtctgccggctgatgcattcagccgttcagccagtgtttctttgttcaaaatgcggcctcctctttttctttatatggtacaatatgctatcggatcgcctgatcatagtcaataaaaattgcagaatataccgcttacatgataaatgtctttctattctgacataataaaagaccgtccttttacggacggcttttcactttgtatgaagcactcttttttcaaatcgggaaatgtccgtaagagagccgataacgatgagaatatcttctttttggatcatttcagtcgccagcggagatacgatcacttctttttctctcttgatggccacgatattaatgccgtacttcgcccggatgtccagatcaagcagtgtgttgcccgcaagcctgctgttggccacgatctccacaatgctgtgttcgtcggacagctccaaataatcaagcacattatttgatacgatgttgtgggcgatgcgttttgccatgtcacgttcagggtggacgatgtgatcggccccgattttcgcaagtactttctcatgataatcgttctgcgctttaaccgtgatcgtgttcacgccgagttcctttaagatcagcgtcgttaaaatgctcgcctgtatattttcgccgattgccacaatgacgtggtcaaagttgcgcagccccaagtttttcagcaccgattcatcggttgaatcgccgatgaccgcgtgtgatgcgattttggcgtattcatttactttatcttcatcaatatccatcgccatgacctcaaggccttcttcacttaatgctttgcaaatacttccgccgaagcgtccgagaccgataacggcaaactcttttctcataacagtactcctttaaacaatatctctaataggaatagtatcacattttcggcaatgagttcatatagcgtttaagcttttctgaaaaggcgggtgataaatacaggtccgctccgcgttcgatttcttcctgatagtgacccggaggcgcaatttcctccgctttatcaagaaccagaaacgtcaggacgcctctgtatacacggccgccggcacacacttctatgaacgcgggacggtatgtgtgattatcaacaccttctcttttgtacagataggttgccgcttcaaacgggagcttgtacagcacgccttcagttcgtcccccgtcttcaacaagatcggctctggaaccgtcaggacgccttaacgtgaatctcgtcgaatacccttcaacaaccgcccctccgaccggctcggcaaagaagtggtcgacccccgcctgtttaaaccgggcattgtccatacaggagccgtaagcgaaataataaaccggactgtcatcctcccgtttcataaaacggtattctttccagtctccgcttttgatacggctgaatgaggcacactggccgggctttacgacatatgcgaaggcggttttattcccggcatccgtcgtcacggcaacctctttccggtcaaaatcagcataatacatatccagcttacggatcatctgatgatctgtttcatacaattccccgtacacaaaagctgtttctgctaaagacgccgcaggctgacctttatccgtttcgtacagcacaccgtttatcgcggcctgctcgcacacacatagagcgcctttcagcagttcatggttttcttcacgcttccgtaacaaaccgtatacaaaaagaagcaagttatttttcctccttttggacagcagccgcttctaacggcagaatcacctgaaacgtactgccttctccatttttgctcttaatgttaagtttaccattatgctccttcagaattcgtaaacaaatcggaagcccgagacccgttccctgatcttttgtggagaaaaacggtttcccgatattttcaagcttttctttcgacatgccgtttccttcatcctgtatgctgatcaccgcgtattcttcatcccgttctgtataaatatgaatattcccgccgtcaggcatcgcttcaatcgcatttttaataatattgataaatacctgtttcagctggttttcgtcaccgttgaccatacaggactcagtctgcctgaaatccttctcaatcacagtgttcgacagcaccgcgttcgtgtcaagaagcgtcgccacctgccttaaaatatggttgagatgatgagcggtaaacgtcacggtctgcggcttggcgagcagaagcagctcccccagcacgagatcaatccttttaatctccgaaaaaataatatcgaaataatccgttctttccggatactgggctttcatcagctggagaaagccgctgactgacgttaaaggatttcttacttcatgggcgattcctgccgcaagctccccggcaatggccagcttttgagattgcatggcaaggcgttcgttcgtttccagaagctcgtcgaccgcttttttccgttcactgatatcagacatcgtccccaggctcccgacaaatttctgtctgcggtcataatacagcttataatggacttctccccaaaagatcgtgccgtctcttttaatatatttggccgtaaacattcctgacggggactgctgcttgatttgggagataatataatcaatgatatgtttttcttttataaaataatcattatacatcgtgcccatacattcgctgatggagtggcccgtaatcgtcgtccaggcctgattcaaatatgtaatattcccttgtgaatccgtctgaaaaacgatttcctgcagattgtccatgatccggtttttctcatctgaaagcgcctttgctttctgctcgctgtccttcagctccgccagcagctgctttttattgtccacataataagccagcagccagacgctgattaatgtgacggcggtaaaggtgatgtcaacgggccagttaatcggattccgttcaatcatataaaataaataatcccaaaacataataaaaatcattgccaagattaaggaaatgatacgcgcttgatattttcccatagtcccacctgccgctaacatttctacatatattgtaacattgttgactgcattattgactaaaaaatgataactattcccaattaattgagcaggttcgcttacttttcccgtgagtttttgcacaagttcataataaaaggacggaatgatgccccgccctttttgctgattatgatctatcttttaacgcttcttcgatttcctcaagcagcattttcgctccttcaggacttaaaataattttgccgttgccgtactcctgattttcggaggtaatttccccggtcatcaagcaaatgccgtgcggcttgtatttttttaagacaattttgtctccgtcaacgaaaaattcaatactatctttaatagcgatatccaatgctcttcgcaattcaatcggcatgacaatacgcccgagttcgtctacttttcttactacaccaattgatttcatagaaatcccctacttcctttaatgtctcttctttatgtccaaggaaaatccttcataaacgtagacgaaaggaacggagcaaaagtttctcagcatccggaaatgaatgttttttacaaaagaaagccttttgaaatacgggatacagactttccctccttttttacaaaaacatttcattcccggcggaaacccccaaaaatcgtggtttttctcagaaactttaaatgtagaatcaattaaatcaggatagggattgggtgaaaacatgtttcaatcaactgagatcggaatcgacttaggaaccgctaatatacttgtttacagtaaaaataaaggaattattttaaatgagccttccgttgtcgctgtagatacaacaacgaaagcggtgcttgccatcggaacggatgccaaaagcatgatcggaaagacgccggggaaaatcgtcgccgtacggccgatgaaagacggtgtcattgctgattatgatatgacaactgacttattaaaacacattatgaaaaaagccggaaaaaaaatcggaatgaccttccgcaaaccgaatgtcgtcgtctgcacgccttcaggctcaacggccgttgaacgccgcgccatcagtgacgctgtcaaaaactgcggagcgaaaaacgttcacttgattgaagaacccgtagccgctgcaatcggggccgacctccctgttgacgagccggtcgcaaacgtcgtcgtagatatcggcggcggtacgactgaagtcgccatcatctcattcgggggcgtcgtatcctgccactcgatcagaatcggcggcgaccagcttgatgaagatatcgcctcgttcgtcagaaaaaaatacaacctgctgatcggggaacgcacggcagaacaagtgaaaatggaaatcggatttgcattgatcgaacatgtgccggaaacgatggaaatccgcgggcgtgacctcgtaaccggtctgccgaagacaatcagactgcagtctaatgaaattcagcacgcgatgcgtgagtcgctcctgcatattcttgaagcgatcagagcgacgcttgaagattgtccgccggagctcagcggtgatatcgttgaccgcggcgtcgtgttaaccggcggaggctcccttttaaacgggatgaaagaatggctgacagatgaaatcgtcgttcccgttcatttggcggcaaatccgcttgaatcagtggctatcggcactggacgttcattagacgtcatcgacaagctgcaaaaagcgattaaataataagattgtgcttcttttttctccggccggctcatattgtgagaactggagaaacattaaggaggaagcatatgcttagagatgtgggaagacgcgtagcagtagccgtcattttaagcggaattattttgggggtatgagcatttcactggccaatatgccccattctccggccggcggcgccgtaaaactgaatcatccgtaaagacgcagcaaaagctgtgtctttttcgtttgtgctccttcctttcctttatgaggcgatatttgatatgatgagaaaaaccgatgaggaggaatgaacgatgagttcgtttactgaaaagttaaatacatatgctcagctggcggtagaagtcggcgtcaatgtccaaaaaggacagcatgtcgtaatcaatgcctcaactgatgtccgggaacttgtcagactgcttgccaaacattcttatgaaaaaggcgcaaaaaacgtcaccgtaaattggcaggacgatgaactgtccagattaaaatacgagatggcaccttttgaagcgtttgaagagtatcctgaatgggaagcaaaaggaaaagaagagctcgcgaaaaaaggggctgcgtttatttctgtcgtctcatccgaccccgacctgttaaaaggcgctgacggcaaacggattgcagcgttccaaaaagccgccggaaaagcattgcatacatacagacaatatattcaatcagataaggtcagctggacggtgatcggagcggcttcaacaggctgggcgaaaaaagtgttcccggatcagccggaagaaacagccgttcagcttttatgggaagaaattttcaaaacaacccgcgtaaatgaagaaaaccctgtggcagcatggaaaaaacacgatcaaaatcttcatgaaaaagtggaacacctgaacaaaaaacattacagcgccctgcattatcaggctgaaggaacagacttaaccattgaactgccgaaaaaacatgtatgggcaggcgcgggaagcgtgaatgaaagcgggcacgaattcatggccaacatgccgacagaagaggttttcacccttccgcagcgtgacggggtgaacggcacggtttccagcacgaaaccgcttagctacggcggcaacattattgataacttcactcttacctttgaaaacgggcgcattgtcgatgtgaaagctgaaaaaggcgaggagattttaaaaggcatcgtcgaaaccgatgaaggctcacactatctcggtgaagtggccttagtgccgtacgattcaccgatttcacaatcaaatattttattttacaacacactgtacgatgaaaacgcctctaaccacttggcgatcggcagtgcgtatgcctttaatattgagggcggcaaacaaatgacacgggaagagcttgtcaaagagggcttaaatgaaagcattacacacgtagattttatggtcggttccaaagaaatgaatatcgacggcattaccgcggacggcaaaagagaaccgatcttcagaaacggaaactgggcattttaataaaaaaaaggaggcgatcaggcctcctttttatttcgcttcatacatttgcaagttggcgaagacggtttccaaaacaggtgtatcaattgacaagcctttcgctttctcaagcaaaaagccgtgtaaatgatcaccttccgtcaccctgcccttttccatatctctcagcatcgacgatttcatatggtaagacatgcttgtcaatgtgcgataactctcttcttccagaccaggatctttcgggatgccggcagccttgaaaatggctccgatttcagcaaagaggcgctttgccgtgctgcggccgccttctgtttctaaaatcggtccgaccggctgttgaaacagagtggtcactcccgcctgcgcggcaataaacatatattttttccaaatgtccttttcaatatccccgctgatgatgacatccgctttcacgcctgcaaatgcgttttccagctcattcatacgttctgtgcgctccccgttccattcaccgaaaacaaaacggtgggcagcgctcgtatgaagaatttcccctttgtcgttaagggcgctctcaataaagcagaggccgcccagcacctgccgttttgaaaaagcttcaaacagctggttatagtgcctgtatccgtttaaaaaaggaataatgaccgacgaaggcttgacaaacggtttgacatcccgaatgacgtcctgcaaagaatacgcttttgaagcgatgataacggcgtcaaatgctccttcttcgcccgccaacattaatttcggcttgattgaaacatcaccttttgcacttttgacggtcaaacccgtttcttgtaattgttccgcccgtttcttgcggacgagaaatgtaacgtcatttcccttttctgcaagacgcgcgccgatatatccgcccactcccccagctccgacaactaaaaacttcatgatgcattcctccgtctcttttcaatttatgtattcctttattgtaatgggaagtcagaagattgaaaacttttttcataaataaaaaagcagagtctcccctgcttctttattacgcgtatagctcttcaagctttttctgcacatccgcgttttcaagaaattcgtcataagacatttgtttgtcaacaatgcctttaggcgttaattcaatgatgcgattggcaattgtctgtacaaactgatggtcatgagatgaaaacagcatagcgcctttaaagctgattaagccgttgttaagcgctgtaatggattccaaatctaagtggtttgtcggttcatccagaattaagatattcgcgccggaaagcatcgcttttgaaagcatgcagcgtactttttctcctccggaaaggacgtttgattttttgttgacttcttctcctgagaacagcatgcgtcctaagaaaccgcgcagaaagctttcgctttggtcatgcggcgagtattggcggagccagtcgacaaggttcgcatcgctgccgtcaaaatattcgctgttgtctttagggaagtacgcctgagaagtggtcacgccccatttaaatgtgccgctgtctgcttccatttccccggaaatgattttaaacaatgtcgtaacggcaagttcgttgcggcccgtaaatgcgattttgtcttctctgttcataataaagctgacgttatcaagcaccttaaccccgtcaatcgtttttgttaagccttcaacccgcagcacgtcatttccgatctcgcgttccggcgtgaaattgacataaggataacggcgtgatgacggtttgatatcatcaagcgtgattttatcaaggagtttctttcttgatgtcgcctgctttgatttagaggcgttggcgctgaatctggccacgaactcctgaagctgtttaatctgctcttcttttttcttgttggcttcctgagaaagctttaaagcaagctggcttgattcataccagaaatcatagttgccgacgtacacttgaattttattaaaatcaagatcggcgatgtgcgtgcacactttatttaaaaagtgacggtcatgggatacgacgataactgtgttctcaaagttgattaaaaactcttccagccactgaatcgctttcagatccaagtggttggtcggttcatcaagcagcagaacgtccggcttgccgaacagcgcctgtgccaaaagcactttcaccttttctgaaccgcctaagtcggccattttcttcgtatgcaggtcttcagagatgcccagcccctttaacaaaatagcggcttcactttcagcttcccatccgtttaattccgcaaactctccttcaagctcagcggcgcggatgccgtcttcatctgaaaaatcaggcttcatataaatcgcgtctttttcctgcatgacttcgtataaacgtttatgtcccataatgacgactttcagcacttcgcagtcttcatattcaaagtggttctgcttcagaatggcaagacgttcgcccggactcatatggacatcgccggtctgaggctccagctcaccggataaaattttcaaaaatgttgattttccggcaccgtttgcgcctattaatccgtagcagttgcccggcgtaaatttaatattgacatcttcaaataacttgcgatccgcaaaacgcaagctcacattatttacagcaatcatttagaatcctccatcgtgtctatcatcattaaaagtataccatgaataaaggggaagagaaatgtttccctgcgaatatacgggtttgaaaagatgcaggcgtcaaacccggagcgctgtgatacaatagatatatatacatattcatcacggaggaacaagttgaagcttttaacactcacagaatactgtcttatgattttcttcaccggggtttttctggccgtcacaggctttacggcacgtgacatcggcttgtacgtcggaatcgccctcatttatacgttttcgcatctcttttccaaacggatgcttgaaagacgcggcaaagagaagaagcaggtgaatcttttttcagcgttctggccattgtcggatcagtgctggccacggtattgttcatcgccgtcgcggcctcgtttgccaaataaaaacgcctgctgtccgaatcgggcagcgcggcgtttttattttgtctgacgcatatcatgaaacgggaagaacacaaacttcgaggtgccgacgatccggttttcggcaattaagccgaggccgttccggctgtccattgagttcagccgattgtcgcccatgacaaagtatttgcctttcggaacctttacggggccgaaatctcccgtcaggttgactcccagttttttcgcttcttttttattgctcgcgaggtacggttctgcgatttttttgccgtttatgtaaagcgtgtcatttttcatttccaccgtttctcccggttttccgatgagccgctttacataatggactttcgatgtatcgccgttaataatgacgatgtccccccgctcgatttctccgatataattgacgcttttgttgacaaacagtctttcaccgtcatgtaatgtcgggtacattgatgatccttccactaagtacggttcaaacaggaaatggcggattaacagcgcaagtgcaaccgctataatgatggcctttccccattcccaatacgtgttggattttctttttaccgatttttcagaagtaggtttttgttcttcagtcaacgtggttcctcctagacgatcactgtttcggttcatgtaccatctttactttatcacaactcatcacaaaatacataacgcttctatgcgtatatgattgaaaaaagcgcccgtaaaggacgcttttcgcttatttctctactaccggttttttgatgattcccaagataaccgccgttacaatcgctccgatcacgatgctcattaagtaaagcagcggatggttcgtaatgaatgcaacgaatatccctccgtgcggtgcaggaagcgttacccggaaaaactctgtcagtccgcccgctaccgcagaaccgacaacggctgcagggatgacgcgaagcggatcagccgctgcaaacgggatggcgccttctgtaacgaaagctgctcccatgaagtagcacgtaataccggcttcacggtcacgtttagagaatttgtgtttaaagaatgttgtcgccagtgcgattccaagcggcggagccattccgcccgccatgatggccgcatgcggcgcatagtttccggcatcgatcatcgcgataccgaaagtgaacgccgctttattgagcgggccgcccatgtcgatagccatcataccgcctaaaataatacccattaagacaaggtttccagttccaaggctttcaagccaatttgttaagaaattcataaacgctgctacaggtgtgttaatgacaaactgcatcaggacaccggtgataaaaataccgagcagcggataaatcaatacaggttttaatccgtcaagagtctgaggaataaagacaaacagctttttcaaaaggactacgacataaccggctaagaatcccgcaatcagtccgcccaagaatccggcattcgcctgcgtagccataaatccgccgaccatacccggcgcaaatcccggacggtccgcaatactcattgcgatgaatccggcaagtactgcaacaatcagctttaacgcattaccgtcaccgataaagttcagcgctgcagcaaacgtgttgtatgtcgggtctttcggatcagctgaatgaattccccagaagaatgaaatcgcaacgagaattccgccgccgacgacaaatggcagcatgttgctgacaccgctcattaagtgtttatagaaagtacttccgatgcttgtgcctgatttctgtttcggaccgtcttcatttgaagcggaagatcctccgccgctgccctcgtaaatcggcgcatcttggttaacggctttttcaatcagttcctgtggacgtctgataccggccgtcacaggcacttgaagaacatgtttgcctttaaagcgctccatttcaacctgtttatcagccgccacgataatcgcaggcgcgtcttcaatttcttgagccgtcagcttatgtttaataccgcttgagccgtttgtctcgactttaatgtcaacgccgagctctttcgctttttctttcagtgcgtcagctgccatgaacgtatgagcgatacctgtcgggcatgccgtaaccgcaaggattttcccttttcctgacggcgctgcctgttcttcctgctcttcttcttcctcatcgtcatctttgtcatgctgattgatgatgtcaatgatcgcatcttctgattcagcttcaagaagctgtttgcggatttcctcacgcataagaagcgttgaaagtcttgataatgcctcaaggtgcgtattgttcgctccttcggttgccgcaatcataaagaccaagtgtgccggctgaccgtctaatgattcataatccacaccatcttttgaacggccgaatgcaatggccgggttaatgacgctcgccgtcttcgcgtgaggaatggcaataccttcgccgattcccgtcgagctttggctttcacgatttaaaatggctgctttgtaagcctctctgtcatttaatctgccggctttgtcaagcactgtcaccatttcatcgataacgttttctttctctttgctttctatattgagatgaattgtatctcttgttaacagctcagttatcttcacttttctttcctcctctatagacgtgtgactttaacttcaggaagaagctgctgtacaaactcttcagttccgagttcttcagaaaatgccgtcgcgcttccggaagcaactcctaaacggaacgcatcttccaaaggcagctgttttgaaattcccgcaaggaatcccgcgacgacggaatcacctgcgcctaccgaattgacaagctttcctttaggaacattggcgaggaaaaccgcctctttcgtaaataaaagcgcaccgtcgccagccatcgaaacaatcgcgtgttcagcgccttgttcaattaattttttaccgtaaggaacggcagcttcggctgaatcaatgaccgtattgaacatttccccaagctcatgatgattcggcttcatcaaaaacggtttcatttctgtcgctttcatcagcgcttcaccggagatgtccaccactacccgggcattctgctttctgcatgcctcagcaattttttcatacgtgttatgcggcagggaagaagggatgcttcccgctaaaacgacgatgtctccctcttccagagcggagaactgttctaaaaaggcattgaacacttcgtctgaaatcgtcgggccctgtccgttaatttccgtttcatcgcccgttttcagttttacatttatacgcgtgtcttcatccacctcagaaaaagccgtttccagaccttcctgctgcaaaaatgacgtgatataatttccggtaaatccgccgacaaaccccaatgcttttgacggcacatggtgtcttttcagtaatctcgaaacgttgatgccttttccgccgggatacttcgtgtcatagctggaacggtttaaaccgcctacggcaaaatcttcaacgtgaacgatatagtcaacagacggattgagagttacagtgtaaatcatggtttcactacctttacgacagttttttcttggtaatcatcgaatgcaagttcttcagcttcagtggtaatgatagctgcatcgcccaaggcggcgaacgctgcgaaagaaatctcgccgaatttagaaggatcggctaaaacatacgcatttttcgcctgtctcacagcctttgtcttcagaagagcctcatccggatcgggtgttgtaaagccggcttcaatgtgcacgccgttcaccccgagaaagcttttgtcaaaacggtactggctgaccgccgttaatgaggcgccgccgatcatcgcacctgttctatgcttcacatatcctccgagaagataaaaaggaatccccttccttattaaagcatcgatatgcataaccccgtttgtgacaaccacaatgtcctttgtatgatctataaaatcaatcatgtgcaatgtagttgttcccgcatcaaggtaaatacagtcaccttcttctaataaagatgccgcttcttcagcgatcttcagtttatcctgaaggtttttggaggatttttcaagcatatcgggttcttgcctgctgttggaaagtttagacgccccgccgtgaacgcgctttaaaaatccgcgctcttcaagtgttgataaatctcttctgatcgttgattcagaagcgtttgtcatgcttatcagctcttgaatcttcaccacatctcgcttttcaatctgatccataatcagctgatacctttcaggagtgagcatattccgcctcctttgaaaacgtattcatttcggctgcaagataattgtaaacgctttttttacttcaagcaactaaaatcactcaaattcattcaataactatcaaaatctttcacatttgttcatattaacgtatgtacatagggtttgtaaactgtaaattcgacaaaaagggggacaattgtatgacattttctttttatcataaatgaaaaaagtctattatattcattcaatcattaaaacacaaaaaaccccatgcagactgcatggggcgccggttattcataccgtaacgcttcaatcggatctaagcgtgatgctttgttggcgggcagcatgccgaagatgacgccaatcagcatactgaacagcacgccgatacaaaccacctgccaggaaacgagcgacggccagcctgcgataagggaaacgagtgttgctcccccgtagccgagaccgattccgattaagccgccgattaaagtaagcacaacagattcaattaagaattgtgtcagaatctgtcctctcgtggcaccgagcgatttgcggatgccgatttctcttgtccgttccgtcactgatacgagcataatattcatgaccccgatcccgccgacaacgagagaaataccggcgatcgaaccgatgatcgtcgtcataacggtcgtgacctgaccgattcccgccgcgatttcttccatattcatgacttgataggcctcttttgtaccgtgattgtcatttaagagacgggccgcttcttttcctgttgttttgatttgatcagcggactccgtctgaacggaaacgttgctgtagtcgttagtaccgaaagacgttttcagcatgttgaacggcacatacatttcactgagtcctaacgataaaaagccgctctcttctttcagtacgccgattacttctacgggctgtccgccggcccagacgattttcccgagcggagacgttttcccgaacagcttttcagccatttttttcgagatgattcccgctcttttcccggaaagaaaatcattgtccgtaaacgtccgtccatcttgaacgtccagcttttttacgtccaagtagccgctgttaatgccgttcagcgtaatatccgtgtcttcttcatggtaacgggccgtcatggattttaccgcggaagcgacaacctgctttacgccgtccactccttttaatccattaatatcttcttctgtaaaactcgcttgctgtaaggcgttcggattggctgttaattcttcatcactgggcatgtaaaacaattcaatcgtattgcccggcccgctgatggattgcttcagcatttgctctccgccctggccgacagccacaacaacgattactgaaccgacgccgataatgattccgagcattgtcagaatcgatctcagcttgtgagctcttacggaactgagggccatccggagattttctgacaggctcattcccccactctcctctgctcagaatcgcgggaaacgatcatgccgtcacggacgaaaatcactctgtttgtacagtccgccacttcaggctcatgagtgacaagaaccacggtcacgccctctgcattaagctctgtgaactgctccataatggaaatgcttgttttcgtatccagcgcgccggtcggttcatcagctaaaatgagcttcggttcgttcacgatggctcttgcaatcgcgacacgctgcttctggccgccggacagctcattcggcatgtgacgcatccgatccgccaaaccgactttttccagcgcgtgctcagcccgttcctcacgctcttttttgccgataccggcgtagatcatgggaagttcgacattttttcttgcattcaatcgcggcagcagctgaaactgctgaaagacaaaaccgattgatttgttccggaccgccgcaagctctttttcggtgcatgaagaaacatcttcgcccgcaagactgtaattgccggacgtcggtctgtccagacagccgatgatattcatgatcgtagattttcccgatcccgagggtcccataattgacacatattctccttcttcaatcgtcaggtcgattgaacggagaacatcaaacgtctccttgccgatctgatagctttttttcacctttgaaagctgaatcatctatgctttcacatccgttccgtcagtcaaaccgtcagccggattcagaatgactttatcatcctttgaaagcccctcttttatctccgtaagctgatttgcggtatcgccgactttaactttcacgcgtttggccttcccgtcttttaccgtaaagacccagtgctcatctccgtcttttttgactgcggaggacggcagcgtgtcggctttccgtttgtcggtttcaatgttcataattaatttaaatcccggcttgccttccggaaggtttccgatcagcttaacctgaaacggatactggacggcttgttccgtgctttcccccgaagcagcgcttgacttttgatccggaacgaggccgacagccgccactctccctttccacgttttaccggggatggcgtctgaggtgattgtaacgctttggccctttttcactttcagcgtgtcgtattcggacaaattgccggcaacgaccaggtgttccgggtctcctatatgtataaccggttcttgaatatccgattttttagaagccgcttcttgatttaccgagataaccgtcccgtccatctcactcttaacattgagattcgacacttgattttcaagagactgcttttgcaaatcagattgctttaattcgatttccgccgttttttgctgaagctgcagatcagtccgttcggattcaatttgttttttggcttccgcttctcccacttgttttgccagatcttgttccttgctgtttaatgctctgagtttttcttcaacttgttcgatttgcatccgttttgattgttctgtcaactcattttgttctttatcaaggttgagctgctcatttgtatacgtgactaacgacgaccctttttttactttgtcgccttcttttactttcactttatcaagagttcctttatctgcttcataaaaaacatactgttctttagaaaatttaagtgttcccggaaccataaccgtagatgagatttctctgttttccatggttccggtttcgattttttttccggcgctgccgcccgcgggagcggcagacttataaatattgataccgataaatactgcaacaattacggcgatgccgattccgatccaaatttttttcatgttatacacctgctgtcactgaacttaacagtcctccgactgccgaaaccaaaagcataataacaaacaggacaatcgcggaagtccaggccgcttttttcgaaatgccgcctgtatagcgaagtcccaaagccagcagaatatagctccagatgctgaaaatgtcgaacgcgcttaaaaagaccgcgacgccgtctccggccggtatgacactcgccaaagatgtaacggcgtacaatgagcccgcaccggtaaaataagtgacaagaccgttaataactaagccgatattggtaataaacgccgtaaacaggctgagtgagagcatttttttgtaagttgtcacgccgcctgacattttgacgcacagccagtaaatgagcggaacgataaacagagcgataatgcccccgaagattcctccgaacatcgtgccgaatttagcgaaggttttggtcatttcaatctgatcatccgtcaaaccgtcaagagatgagctgttcagcacttcttcataattcatccccagtccgcgcaaaatactgccggccgcgatgagaatgatgacaatcaggagaggtatgccgatgaccggcttttcttttaatcttttaaactgcacaacaggacttgtaatgacgccgaaaattgacggcttttccgtgactgccgcattgcttttttccaggtttggttccatatagctgatgcctcctatgtattattctgtttatacgtacgctttaggctgagagaagtttcaatttttttgccgtttgcgtatttatgctaaattgtaacacaaattctcagctttacgttccataattatgtaaaaaaaagcatcgtcagaccggtatgacgggtaactcaaaaccttgtaaaggcactgttatcagcctattcatgcagtgaaaaccgcctcaattgcaaaaccctttaaatcccatttagatattctctgaaattcagcgcctataaacaaaaaagccggatggcaatgatgcacatccggctcttttttcaccctccgcttacaggagggataaaggcaatggtatcaccttctgttacggtgctgttgtcttttacatatgtttcattgattgcgatcatggcattgtcaatcgtctgaaggccgtaccgttcctttaacagcgtttttacagcagacgctgccgtctctttttcgtcaagttcaatgaccggtgttcccgcctgctccgcaagcccggcaaataataatactttaatcatcgcgattcccctttatccaaatccggttttccgttcggatagggcgttgtttccagctgatcgcctatccattcttccccgtcttcccagatttcttttttccatatcggcacaatctgttttatccgttcaattgcatattcattcgcctcatatgccgcctttctgtgcggagaagacacagcgattacgaccgctgcttcaccgatatcaaggacgccgacacggtgagtgattgcagcttcggctccttcccatttcgcgctgatttcactgccgatttgagaaagcatttgaacagccatcggttcatacgcttcatattcgagacgcaccgtccgccgtcctgcagtccactctctgaccgtgccgataaacgttgtgatggccccggcttcacgcttttcaactttttttacgatattttccgcaatgataggttcccttgtaatttgaaaacgttccatttaagcagtttcccctttcagctgcgaaagcacaaacataatggcagcaggatcgtccgcatggaatacgggcttgcccgcatctgccggcatatgctccgtatttctgctgacaaccgcgatcacgcgctccaaatgcttcagcttttgccaatcttcgctgtttttgatcataatgattttcggatgcggcgcatgtttaaatccctctatgagaagaccgtcaattcccagacattcatacagactgatcaaacccgccagatcccatttttttcgcgccgtaagctgcaggacgccgtccccttctactgccgtaaccgcggctccggcttttgaaaaacgctccgagtcttttccgtcagaaaaaggttccggttctccgccatgtccgtgatgttttaaacatccaatatcgcactctttcggcgcagctttcagcacacgttcaataaacgttgttttaccgctgttttgaaaacctacgatctggacgatcgggaaagaattgaccacggccattcacttccattctcatcacggatgaggagcgcgtgaaccgtccggcccgcttcataccccctcgttcctcccggcagaaggataaacgcgtttgcttcggcaagagatgtgactgagcttgatttgtcgagaccgaccggtgacgccatcatttttccgtccttatgataaacaaatgccctcacaaatctcgtaaacggattcggcttcggaaagtcgtttgttaacacggcttccgcccatccggaatgaggtttttcattcagaagccatgtctgaatcatcggtttgacaaacagggtgaatccgacataacatgcggacggattgcctgaaaggccgaacagcagcatgtcatcggcccgggcgacagttgtcacgctccccgggcgcattgccactttgttaaaaagaacttccgctccgagcttattataaatgtccggaagaaaatcaaaatcgccgactgacacgccgccggtcgtgatcagaaaatcaacttttttcatagcttccttcaccgcagcatagctgtcatcaaaatcatcggaaattttccctaagttcagcggtactgcacccgcttcaatgacctgggcatacaccatggcagcgttgctgttgcggattttccccggctcaagcggatcgctgacatgaagaagctcggttcccgttgcgataatgccgacaaccggctttctgaccacgggaacggaagcatagccgaaggttgctaaaagagcggttacgcccggcgtgattttcgtccctttttttaatagcgagctgccttttttcgcatcttctccttgatatgaaatattatcgcccgcatgaaaagggcgtttcactgacatgtaattcgtgccgttttcagaaaacgtttttgtcagctcaagcatcactacagcatccgcgcctttgggaatctgcgcccccgtcataatgcggaccgcttcataaggcccgagttctttttctgacacggcgccggctccgatatggtcaatgacttcaaaggtgacggcattgtcacgggaagccgtttttgaatcgctcgccctgatggcaaacccgtcatacggagaacggttaaaagccggcacatcatgatccgccttaacatcctccgccaaatagcggtggagactgtcctcaagcgccacccattcggtatcccccttttttttataccggctcacccggcggactgcttcgtccacctgaatcggcgttcttttttcaagcatagcaatacatccccttcctacagtccgatcactctggccagaactgaattcgcttcttttatatcgtttgtaccgtgaatcagagcccgtccgtcctgaaaaataacgattctgaagcgctcgtacgccatgtgcagcaaaaattcatttgcttccactttaccgatctgcttcagacgtttgacaagctcttctttatccagcctctttaaggcttccgatctgatttgaacggtgtctcttccgcacagcacgcttgctttcggcctgttttcaggctgcagatacggatatacgggctccgcgccgcaggaagggcaatgatcccgtttgatctgatccacatttatgctcatattggtgttattccacacgtcaaacgtgaaaaagcgccgatttaccgccgcatgatttcctgtcagcaatttcagcgcctcagcctgctgataggcggagacgatatgaaccgccggaggtatgatgcctgctgtatcacatgtcgctccgcccacgggcatttgctcaaacaggcaggataaacacggcgtaacccccggaataatcgtcatgcacattccctgactgctgacacaggcaccgtaaatccaaggtgttttcgttttcagcgccagatcattgatgaccattctcgtttcaaaattatctgtcgcatccacaatgcaatccgcttgttcgatcagcggttcgagcgtttccgccgtaccttccgccgcgtaagcatcgatatgtatattactgtttaccgctaaaagacgcgccttggccgccattgctttcggcaggcgctgtctcgcgtcttcttctgtatacagctgctgtctttgtaaattgctccattccacataatcccggtcaataatcgccatacggcccgctccggctcttgcaaggccctctgccgcggctgttccgagggctccggctccgacaatcaggacactgctgtcagccagcgcctgctgccctttttcccctatcggcttaaatcttgtctgccgtgaatagcgctcttccatctgtgttgtccccttgcatttttatttccatcataccatgtttcttaccgatcagtcctgatttgaagactcgacatgcgccaaaagtctggtgtaatcgtcccgtgtgttgatattagcgaactcctccggcccggcgccgatgtcttcagcctgcacataacagacagacagccgtttcagcgtgtctgtcattttcagtttgttttgtgtcagctgatcaaaaagcacatcctgcacccgtttatggtaaaccgccaagaggggctgctctctgttttcacaaaccggtatgacagcgtccagatttcccgtcagcttcatttcaagcgcagccatcgtttttcttgtcacgagcggcgtgtcacaggatatgaccgtatatgtttcgccttccgtttgtttcattgccgtatatatgccggcaagcgggcccattccccgaaaccgcggctcatcggcaaaaacatgccgctccctgtttgataagaacttttttatatgctcagggcggctgataattaccgtttctccgccgccgaaggcttttttcgcctgttcataaaacatgccgcccttccactttgcaaaagctttcggttctccgaatcttcgggaagctccccccgctaatattacattcacccgtttcatgtcatcgctctcccattctatataaaagcatagcaaacgcctcagccgaaatacaatattacggtgcttgtctgtttaattaagaggaatagccgttgttcctttcccatattgtagtgttaacatcaagagggagatggttcttatgaaaatatcaggtccgtttttccacgacacttctcaagagaacctttacttgaaatccgaactttccagatgcagaaaaataatttcggaatttgaagcaagctacttccatcaaaaaaacaataagcttcaggaggaaaacgccaatattaaagagcggcttcacaagctttctgacgaattggaagccatggcgcaaaaacacaaacagactagtgacacggaacgttctttgcatgaaatcagggccgggctgctcgataaaatcgtcattctgcaagaactgcttcagcaggaaacgtttcggcggaaaaatgagatggaagaaaaacatcggctgcatcttacaaatgtaaaatttgaagaagaaaataaaaacttacatacccgcatccgctcacttgagaccgccgttcaaaccgaacggacttctcacgaagatatgaaacagcgttatcatgccgctgcagacgaaaatacccggctccaaacacaaatgatagaaaaagaataccagctcaaacatattaaaatagaaattaatcatatgagagatcgaatactagaaacaaaagaacggcttgtagaaatagaaaaaacgaaagaaaagttatttcaagaaaccattctttcatataaacggcagcttgacgaaagcgatgcttggattgccggccattttgctgatattgacagccgcacggcggaaccggcggaacaaactctggaaatcccttccgtttccaaagagactgttcaggcagaagacttgcttacagccgttaccgaacaagtcatctcccttcaaaaacaatttgtagaatcagagtcccgcgatcagtcgtttgatgaaaaactggatgcgttgaaagaacgagctgacggcgaaaagcctttccaaaaatatgttgtcaagcttgaaaaaaagcctggaaaagatgcgtcacttccgcagaataaacgggaaaacgcaaaaaaactgcttgagtaacgcaagcagtttttactgttttattcagcagccgtatcatttgccgtttctgctgtttcctgagaaatttctccctcaagaatatattggccgcgatatggttttttcacttccggatacattttaattaagctttgcataaatgttgtcatattaggaatttcaaggccgctttccttttcaatttccttttgcagttcggaacttttgatcgctgcattgtggcgtttcaatgttttaatcgctgcttcgcgcagttttgccgcttttgatcccggtctcgccgtccctcttcttcttcttgtagaaccgtctggaatgccggcgggaagagacgtaatagactgcatctgcggctgggaggattgcggctgtgtctgcggcttttgatagcttctcatttcctgtgctgcaagctctgcaagcaccgggagagagtcactttttttctccggacgaaactctttttttgtatcggacaggctgcccgtattgtctaattctctcagttttgcatatattttatcacgttctatttgatattcacgaatgacttttacctctgcttcgttcaattgttctaaacgtaagcgcagcgcttctctttcattaaacatgtgtaaaaccccctgtcaaaaatttaaacgcttttattaagatattagattacaaaagtaattttatcaactattattttatcattttactattttatttactctatgaaaaattgcttattttctgaaaatggtactttatatacaaaaatcccttatcatataggggattctggacaaagttccaatttattgaaccatttcaaaatataacttgaaattacttgtttaatgaaaattagcgtgatatctacaattttcgactataatatgtaaaagttaatgatatggataaaacaagcggtacagcgtgtttacggctgtttctcttattttttaagccatacatgccatattggaattttttatccaatagccacaaaaaaaccctgttacctaacggcaaagggtttgcagaaccgagacaatagtccggcggagattgtcccgattactcagaagcctgctccgtttctgaaagtacccggctgatgcgtttttcaagcattttcatcccgctctctcccgcttgaaaatggcggagctgtccgcttttatcaaaaacgtaataagccggcacatattcattttcaaatgcgtcagccagcgtatgatcgctgtcaacgtaaatcggctgagagatatcgtgttcagccgctgttttcttgattttctcaagatcaagatcgtcttcggaacggggcatgtggacggccaccacattcagctgatctttatatttatcacgaaacccgttcacctcaggcatcgcttctttacacatgcggcagctggcggaccagaagtgaatcagtgccggctttccgccgaccagctgttccttcgtaacttctctgttaatccatgctttagcgcctgttaattcaggcatttgctgatgtaatttcatcttatttccctccttatgaaaaaagttttttgccggggctttcagtccgcctggcaacgttctcctgttttccctccaaaggaaatgatttggctgaatcaccatgttaaaatgagtgtggcgattccttagttcatatcttcacaaaaatgaagatattgaaaccgggcaatatgaacaaatcataaatgtaataactggtttctatgaaaaggtttatcttatttaaaaaacgggtatatcacttttagctttttcctcaatagacttgaaaggaagacatcactatgattgatttaaaacactttgattgggccgggcttctcacatctgccgggattttcatcataaagctggctctcattattttagcgtattttattttccggacggcaggaaaaaagctgatcaagcatctgtttcagaaattcgagcaacaaaacaacctctccacaggccgcgcttatactttgcgaagcctcgcgcttaatgtgtatggatacatcctgattttcgtttttatcgtaatgattttggatttatttcactacaatccgagcgctctcattgccggcgccggcgtggtcggtctcgccgtcggcttcggggctcaggggcttgtcagtgacatcgtcaccggattttttatccttttggaaaaacagatcgacgtcggtgattatattacggttgccggctacagcggcattgtcgagcaggtcggtctccgtacgacgcaaatccgtagctttgacggcacgcttcactatctccccaaccggggcattacgaatgtgagcaaccattcccgcggaacgatgcaggcgcttgtcgatattaaagtgccgcttgaaaaaaatcttgatgaaaccattcaaatcctgcaaaccgcgtgtgacaaagcagccgctgagctcccgcagattaaggaagggccggacgtcatcggggttcaggatttaagcacgtcagaaatggtgatcagaatcattgccaaaacagaaaatatggagcaatggcgggttgaacgcgtactgcggagagaaatgaaaatcgcgctcgaccgttttaaaaacgccgcttccgccgaatagaaaaaccgaagcgtaagcttcggttttttctttttaatgaaattttttttccacttcgctgcagatttcgtcggcggtcattccggaagccgtaatgacgggagcctgagttgacgtatcggcaatgccttggacattgctgtcaagtccggttacgacacagcagtcacaattcttcgcatcctcaggagtcttcatcatcactacgtcatatcctttttgttttaacgcctgttctacatccgataaagattgttcaattccaatttttttcgtcatattgaacacctccgttatgtagaatgctcaatttttgttagattattcttcttttcggatttaattggcatacttcgaaaaatatccgaccatgacatttaccgcggtttccatcgcatcttcatccgggttcagcttggcgtgatgaagcccgtgggatgaatcggcccccagccagaacataaagccgggatattttttcagcatatatccgaaatcttctccggtcatcgcttctttcgccgttttcacgtcagcaagctgatgatcgctgacaaattgcataaattcttcggtcaggccgcttgtattataaacttgatgataaacggacggatacgtgacttttcctttgcatcggaagccgatttcaattcctttgacaagctcttcaatccgctttttcaccatacgcattgattcctcggaaagcgtccggatggttccctccagatgagcatgctctgcgatgatattttgcgccgtgcccccggtaatcgttccgacagttatcacagcgctgtcaagcggatccgtatttctggatatgaccgtttgcagctgcgtgacaagcgtgctcgcggcaacgaccatgtcatctgctgtatgcggatatgccgcatgtccgcctttcccctcaagatcgatgacgagctcgctcgtattggcaaacagcaatccgcttttggtggaaatggtgccgaccggcagctctggtgctatatgtagggcggtgattaaatccggcgtccattttttcagcacatcgctttcaagcatcggtgccgctccgcccggtccttcttcagccggctggaataaaaagagcagatcatgtttgacggggtgatggacaaaatgatcaataatgccgagcgcgatggtcatgtgcatatcgtgtccgcatgcgtgcataaaaccggggtgctcagatgcaaacggaagccccgtctgctcttcaatcgacagagcgtctatatccgctctgtaggcgagcattttttccggagccgtgcccttgattttgacaaagatgccggttctccaagtttcgatttcaattctttcttccggatattggtttaaaagattcagcaggtactgctgggttttatattcctgaaagccgatctccggaatgcggtgcagatctcttcggatggcaatgagccgctctttttccatatgtattcctccttgagataagaataaggcgtggattttatcatccacgcccattctatcaaaccattccttacagctggcgtaattcctgtttgatttctgttttgccttttgttttttcatcgatatctttgatttttttcgctggtgttcccgctacaacggtatatggctcgacgtcatttacaacaatggctccggcggcgacaaccgcgcctttaccgattgttacgccttcaagcacaaccgcatttgcgccgatcacaacgtcgtcttctacgacaacaggcttagcgctaggcggctcaataacgcccgctaatacagaacccgctccgatgtggcagtttttgccgacagtggcgcgtcctccgagaacaacgttcatatcaatcatcgtaccttcgccgatgactgaaccgatattaatagatgcacccatcatgataacggcattgtcgccgatctcgacttggtcgcggataatagcgcctggctcgattctcgctttcacatcttttaaatcaagcatcgggatcgcagagttgcggcggtcattctcaatgacgtaatcctcaattttgtctttgttttcttcgattgcgcttttaatttcagcccactcgccaaaaacgacgccggattggccattcaggaatgttttagcggaatcgccaaagctgattccttcgagatcgccttttacatacacttttacaggcgttgattttgtactattttgaataaatgaaataatttcatttgcatccatcattttcatatgtattgtcctcctctgattttctacctcattactgtaacaaaggaaggatacaaagacaagaaaaaaaggaacaagcctttattctgccggctggctgcacagcgcggcaaactgtcttccgaattcccggagctcttcttcctcactgccctcagggttgttttcaattttgaccggcggcagcaccacccgtccgccgcgggccgtgattactttttccaattcgtcaaccgctccgcaaaaaaactcataggacgtatctccggaaccgaacaaagcaaatgtttttcccgtaaactccagtttttccatatcttcagcaatatcgagcatttcatcaggaagatccccgtctccccacgtatatgtgcctaataaaatatactcgtaatcattaaaaagtccggcatgaatatccatcgcttcatatctgtctacggatgcttgtgcttcgatcagccctttttcaattaaatccgccatcgcctcggtgtttcctgacattgtagcgtaaacaagcaatacattccccatcttcgtctctcctttatgcataaaaactaatgtgcgagccgaaccgcctcatacggtctgacaaacttactttcgtaaaggcccgcgcaaaaaaaatcttcttcccggttggccacccgccatccgtgaccgcggatcgtatcaaaccactttaattcaccggcagcgagatcagcttgataaatacgcgaaaatccgctttcgtcctgtgacgaagtgacataaataatcccgttatcctcagacacgtcaagaaatgatttttcccgtacattgtccccggctgtaatggcaaactcctcatgcgtccgcacgtttcggacagcaagctccccccgttctccctttgccgcgccctttgctgcaatgagccagtcattctgatacatcatcattgaagccgtcatgcgctgcctttcgcggcttatacgccggatgcggccttccgtcgtcagatcatacgcccaaatgccgccatgattcatatgaatccgggtgccgatataaaccgtctgaccgtgtaaacaaagcgaacggatgacaggcggctcctttaattgtgaaaaaggcttagccacatgccaagtgacgccgaaatcatcagataagtagatgcagtatgtgccgtgcgcacagacaaatccgtcattccgcccggcaacggcccatacggaggcgctggtcggaaatcgggaggccgtccaagtctttccttgatcggccgatctgaggacggcgcctttttctccagccgcgaatatgtagggccctatataagtcagcacatgaatcctgctcttcactcggaatagtcttttccagccttcttccgccgaaaaatgaaaaataccttcgcctttcacagcgacaaaaaatcctgaagatactgatgccatgacagccgtcgcgcctttatgaaacatggcaccggtctccgtggtgagcggcccatgcaagaaaaccgcggacaaattctttgcagcattcttgatcttcagccgtctcgggcgccagctcaattttcagcgtttccggatataaattggctccggcctgttcaaacgcatcgcaaaacagcgtgaccgcttcgcaaaacttcgggtaggcgtgatcgcctgaaccgaaacaggccgttttcagtccgttgagctggctgtgcagaatatcttcgtaaaaatcttccgcttcgtaaggaagatcaccatccccccatgtgtatgtgccgacaaaaacataatcatatgctttgagagaatccgcatctgcttcgtccatatcaagacagtcaaccgctatctgatgcccgctcagtgtttcttttataatgccggcaatatcctctgtattccccgacatgcttgcgtatatcattaatgctttctgcatatgatcacctcgtaattgataatgattttcattaacatacataacactttaaatgataatgattttcattgtcaataaaaaataaaaaaaagacagcatgattgctgtctttctaaaatgggcgttcctgtttcagcatatctttaatgacagaaacaaaagcctgcacctgttttaattcaaatgccggctcataaccgagcagccatgtgtcacggccgatcggatggtcctttgtatcaagcaggggcattttatttactttatcttcctcttctaaggtgactgacggcagaatggcataaccgatcccgtgcagcgccatttgcttgcacgtttcaatctgatcgacaaggatggtctgtttcggcgaggttttgaatttttgatgccaccaatgctgaatttcctgaaaatatgtactgtcacttttgaattgaataaacggccggtcggtatgggcaatatcatcaatacaggaaatttccgtatcgaccaaatataaatgatcggtcattaaataatctttccggcctttccattccggatttccccggataatgccgatatgtacctgatcttcatacagacttttcagcatttcgctgctccagcctgtaatgagagagacctttgcattcggatatcgttccacatatgtttttaacactttcggaagccagtgctgcccgataatggaggcgacggcaagctttaatgtgccgtgaatctcaccctcaagttcatcaatgttttctctgattctttcttgccgatccgtgacgtcatttgcaaattgtatgattttttctcctgccggcgttaccgtaagtcctttttgagacctaagaaagatctttgttccccaggttttttcaatggtctgcaatcgctgggacagagccggctgtgacacgaataaccgttcggcagccttcctcatgtttaattcctcagctaaaactacgagcatatgaagctcttgaagctgcatgtcgtcctccttttcaatgccttttcgtattccttatctaccattctaatcaaataaaggctgccgaggcaagcgccactcgtatgtatgcgttttctttttctggcatgcgaaagaacaaataggctgatcgtgcgagcctacttattcaatgatctgatatgactgctcaactgctttaatacgactcttctcgtgaaaatgccttcaaagacgccttcatcattttcaacgcagacaaagccgttgttaatgaccatgctgaaccctttgataatcggatcattgatgtggagacggggaatgtctttcagcatgacttcctcaaccgtaatttgatccagcttctcaaactcgatccgttcaagtccgaaaatgctgttcataatcatatttgtcccgatcaaaccgtgcagacggtacgaagcgtcaaggacgggaatggcggtatagccggttttcgtcagcactaatagagcatgctcaaggttgtttccgacttgaacgtgcgccactttatccgcctcgatcataaattgtccgactgttgcatcaagaagctgatctgattgtaagctaatcatgtcacttcgacccctttacatttttcatcaaagcatgtattccctatattgcaataatataaacattatcattttttgtcgaaaagtttccgtcaataaaaaagatactctttgcaatcgagtatcaatttataggccgctgattaattttcgttccgaaaacggtcatagagcgttacgagttttttataagtggtcccatcaacgctttttgaccctgcttctatatcgttgatttcgctggtcaaaagctcaatggcatattcttgattgatcaggatattcagcagaagtttctgttcttcttccgtaaatcgttcactgataagactcatacgtaatcaggccccctatttttaactgaatacctctgaaagcaatgtgaaatttgctttcagctctaccgctagaataagtaaacagaaaaaaatcgtcaaccgcataattcgacattttgcggattctgtatgaaatattattttgtgtaacgattggcataactgaatgctgtgcaggaatcgggcttgattttcgcttcaatacccatcgaggtaatgcggccggtcatttcttgtatcaattcttttgtcagccctttttgaccgatatccagatgcacttcaaatgaaagatccgccccttcatccgcaaaaggcaagagcaaatctgtcagttccataagacagccgtcgaggatatgcgcagccatctcctggctgaacgcggtttccagcgagattttttcgcgaaggctatgtatcggtcttgcaaggtcgtgatttttcaaacagccccaagctcccttgcctgtacggtgcaagtgtatagccgtaataaactttgtgaagtcgcggtaaacttgtgaatcagtccctacagacagcacgtatgctgaacgggggtctttattgacaaagcgtttcagccgctccgtcacgtcttgaaaggtcatctgtgcctcagaaagattataaaacagaaaagaatcagccatgtacggacactcctctttccagagtctacaaccaaacgaacaagcacgttcctttgcataatttaataaagctccgcttgcggaagaccggaagcttggtcagcctgaaaaatcaaatcacattactgaaggagctcaaaaatttcaatagaaatcatgtcaatgttatcaaacggatatgtgttaggtttttcacctttttggaaaaccgtcagttcaaacgtttgatttttttcgaaatatttaacactgcaaattttttcgccgttaacttcaaaataacgctgcatcggctcgttagccgcttccgctgtttcttgcagactttgcagccgcgtgatgatacccattaattgtgacattctaaaaaaagactcctttcaaaaaacaacttcaaatcaacaagtatttattataatacaagtcctacagagcatcataccataaagtagaccgggatggcattttcccgctggattttcaaaaagaaataaacgggaaaaccgtgttttcgaatagtttgaagcttttttcggaatgtcatacacctttcaaaaataatttttcgctttttgagccgccattgtcagatgtatgtaaggagaagcccttttatgcgcagacagcataaaaaaacttggcggggtagcgccaagctttttcggatcttgatctgatagaggggttggggaacagagagtaacttctctctataactaaatgataatgattatcactatcattgtcaatcgttttttaaaactttttcacatttataaaaaaagcggcatactgcagccgctttaaagtaacccgtcctgttcatataaataagagtaaggcagatcgataaataaatacatattgtcatccatcgggtatgaaaaggttctgatcatctcacccgtctcaatatcactgtacaggtcactgaaaaagccttttcttgaattccgcatcttcataatgttttctaaaaagtacggacgccagctccagtttttctccacgtattcaggctgataaagccattcgccggactgcttgaacacatttcccgtcagctgatagccttcttcatcacacatataaattctgaaacagcagtcggtcaggttttccgccagttttttaataaactcatcgtccgcctgatgggttttcttcagttcggaaactgcctgattgacccgcttataaaaattctcagagtgttcgtatactgtctccagcttctttttttctctcgtgataaattgctgaaactccgttttcaagcgtgcttttaacaggctccggtctataaaatcgccgctcggcgcctgcagataataaccttgaaaaaatcggcctccgtttctccatgcgtactggagctgaaaatcagcttctatatcttcatacagcagcgcggcgccgatttttctcgccagcaatgaaatgctgtacagcacatgctcatacgaaggtgacggctgagatactttcagcgcctgcaaatctattttcagaaggtccggtgaaaggagcgcgattctgtccaggttgctgctctccttacctatattgtccaccgcgattttaatgccgtatgtacgatagtaggcaagcatatggtacagctgttcaatgtcgccttcgaaattgtgctcggtgatctcaagcacaatacggttcaattcaatgccctgctcttcgtattctttcaaaagctcaagaaagctctcgccgtggtcaagcatcaatacattcgcatcctgattgataaaaatcaacagatcgcgatcagcttctttaaaccgctccagcgcctgcctgatgactctgtcatcgacctcaagcttatattcttccgggatgccggaatctaagaaaaacggcccgaggctctcaatctccgcatctgccaaaatacggccaagcacttcgtagcctacgactctttgttcctcagcgttaaaaatcgcttggtaatacggaataacatcatcaatattcgtcagtatatcaagtgggtccaacatgttatcacctgcttctctatctttgtctgattatacacaattatatcagcaccacaaatgtttagattaggggaaaaaggaggcagtatggcagcagtttaaaataaaaggggaaaactttttaagatcactcttcagaccggttaattaaggacgttattcatttgtttcaccatcacaaataaaaggataaatataagagcatgataaccggcggctgtccaaaaataatggctccaatcagtactgttaaatatccaatcatcatcatgtttcaactgaaagaaagttccttttttatctaaagtgccaaatgtaagagttgttaacccgccagcactcttggaaacgtcaacttcatacattgaaccggcatgatcagtatgatttattggcatatacgtataatcagataaaattgtttccgccagcttggttggcagagacacatatcatacagccgatgtatcgcctccgagcccactcaaatactccctggctttaataaatttcgtttcatcaggaaaatctatatgatatagcttttcaaatctgattatttcatcagatgtaagattggtattttgataatactccggagtaaaagcgcaaatgataaagtaccaaatattaaagatgataacgaaactgcttacaaatagtacaacgaaccattttaataatttcttcacttattcacctcttaatctttaaaaattatatcataattttgaatagaaaaataaaacaagcgaacggtcacctttaacgttcgcttgttttgcaaaatatgtcatgtaaattaaaacgggtaaggattcagccattgccccccgtccattgtgatacaatccccgtttatataggatgcttcatcggatagcaaaaacgctgccaaagcggcgatttcctccggtgtccccagacggccgagcggcacactgttcatagtgcgggacaccgctttttccgattcaaacagcttctccgcaccgcctgtccgttcaatcgggccgggggctatcgcgtttgtgcggatgccgtatttgctcccccattcaacggccagcgttcttgtcagtgacaatacccccgctttggctgcagcggaatgaacgacacccgctcccgctccccatgcgtatgtagcggccatatttaagatgacgcccttctgctcctgctcgatccaatgccttgccgcggcttggctgcagaaaaatgtgccgtttaaaacaatctcaataacagctttccatccattgggcgtcagcttctctgccgggcaaataaaattgccggccgcattgttaatcagcgcatcgagccggccaaagacttttttcgcttctgtaatcatgtctgaagcggcggaatcagaacggacatccatttgaaaacaggcgacctgcccctcaaaggtctcaatttctttttttgtttcctcaagtgcttcatggttcctccctgtcaccatgacgtgccatcctaattcagcctgttttttcgccattgcttttcccatgccgcttgaaccgcctgtaatgattaccgctttcttatccataacaaacccaccccttttattgaatgaataatcattcataattttatcatagatgtctttccgcgtcattacatgctgagaagggatttttcagccaggctgatgatataatagaacaactctgacaaaggttggttttacatatggagaaaatgacgagaagaacatttttaaaaagaggattcggcattttgggtgcaactctcgcaacggcttgcggaggttacggctatgcccggtatattgaaccgcgcatgattgagatcacccgtcatacaatcaccagccgcctgatcccccgcggctttgacaattttaaaatcgttcaattcagcgatacgcatctcagtgatgtgtttacatccggtgacttgaataaagcagcggaaaagatcaatcagctgaaacccgatctgctcatctttacgggagatttaattgataagccgcatttatttaatgatcaccagcaagcactggccgtgctgcaaaatctggaagctcccttcggcaaactttgtgtttacggaaaccatgaccacggaggctacggtacgaacacgtacaaggctctgatggaagcggctgattttcaagtgcttcgaaatggctgccgtcaggtgcagctgacagacggaagccggattgaactcgcgtttttggatgatgtaatgctcggaaaacccgattatgaaggcaccctttcccgcctttccgaagatgcgttttccattttaatcgtccacgagcctgatgccgctctcaagatcggcggatatcccgtaaacctccagctgtcgggacacactcacggcggccaggtccagctcccgtttttcggccctctcattacgcctccatacggaaaaacgtataccgacggcatgtatacgctgcatgacacagccgtttacgtcaatcgcgggctcggtacgacaagactgccgtatcgatttttagccagaccggaaatcacgctgttcacattgaaaaccgtacaaaaataagacttttatcccgatgcacagacatcccctccgtaatatgtatatggaaaagagcaaaaaggagggtgacgaaactgctgacatatcaagtgaaacaaggagaaaccatctcaagcattgcgcaagacttcagaataagcactgctgctctccttcaggcaaatccctcaatccaatcggtcatatacgcgggacagcacattatcataccgaatcttcccgacccatccaccattccctattccattgtcgtgtatatcggagcgaagaaactggagttataccgcctcggcaggctcatccgtacgtaccccatcgcagtcggaaaaatattgacgaccacgccgaccggagaattttacattgtgaaccgccagcccaagcccggcggcccgttcggcgcttattggctcagcctctctaaaattcattacggcattcacggaacaaataacccttcctccatcggcaaagcggtatcaaaaggatgcatccggatgtataatcaggacgtcactgaacttgccgctaccgttcctaatggaacaagggtgaccattataagatagaaagatcttatttgttaatggaacgagctgatgataatatattacagtgggacctttagggtaaggagcgtgtttatggatatatttaaaaatcgcaattttgtccgtctctttttcgcagcactcgcttctcaaatgggaacgactgtaggtaatatggctttcgctttttacttgctggaccatttttcaaaccagccggcatacacaactttggctgagctgatgtattcactgccgacagttttcgtatttctgattgtcggtgtcgcagctgaccggcttgacaggaaaaaggtcgcagagaattgtgattggatcagagccggactgacgatcgtattatttgccgcattatacaccgggagcatccctctcgtgttctgtattttgttcatcagaagcgccgtgaccaagttctttttcccggcggaagccagccttgtacaagctattctgcctaaggagcattatgcgaaagcggcgggacttaaccagatcctgttcagcatctttatggtattcggcgtcggtatgggcgcgtttatgtataaaacgatcggtattcacggagccattatccttgattttgtcagctttattgtatcaggctttctgatccgcgcctgccgcattccgaaagaagcccgtcagccgaacggcccttttaaatggggagattcgtttctgaaagactcggtcgctgattttaaggaagggatcgtatatattgttaaaaacaaattgcttgcttcccttattttcggcttttttatctttggttttgtcaacggcggctttgccgtactgccgatgtttacgatgaaatacggacttgcgcctgatcattacgaatcacatacttccatcttcaccgtcgcactcggcttcggcctgcttgcaggaagtgtgatcggaacaatgatcgcaaaaaaagtcaaaccgcatcatttgatgtcgattcctattttggcagccggactgctcatttttgtcctcggctatacggataagctgtggatttattatgcggcggctttcatcctcggcatgtgcatcggccctgtcaatatcgccatcggcggctggatgccgaaaatcgttcatccgaaaataatgggccgggtcagcggctggcaggatccttttatgatgtttgcccaatcgattacactcggactggttgccctgttatttccgaaattcgtttccaatattgattacctttattacggcatgggaatcgtgattttagcggtatttgtgttctattttatcgctcttccgaaatacagcgccgaggcagcagaggtcgatgtgcagcaatcattaaaggctgattccgaaaaacatgcgaaacctgtctaataaaggaaaaaaatgcgcccttttcatcagaaaaaggcgtatttttataatcaatatttgcatttcaacgctaaaaaagtataatctatatatgaacttgatcaatgcaaaggagagaaataatggacgaccacgcttattcgaaagagctgcagccaaccatcgagaatctttcaaaagctgtttatactgtgaaccgccatgcaaaaaccgcccccaaccctaaatacctttatctgctgaaaaaacgggcattacaaaagcttgtgaaagaaggcaaagggaaaaaaatagggcttcacttttcaaataatcccaggtttagccaacagcagtcagacgtacttatctctatcggagactactattttcacatgcctccaacaaaagaagacttccagcatcttccgcatttaggtacgttaaatcaatcgtaccgcaatcctaaagcacaaatgtctttgacaaaagcgaaaaacgtattgcaaaaatatgtgggcttaaaggaaaaaccgcttgccgccaacaggcagcagcccgcttatcataaacccgtatttaaaaaacttggtgagagttatttttaattccgccgcaaaaaagccgatgcgtcatgcatcggcttttttctattcaatcacgtacgtatccacttttttaatgagctcgctgatttcaggcttgctgatctgttcatccgctccgactacttcgccccggtggcgcaggtcgtccgtaatgagggacgagaaaatcataatcggcacatcagagctttgcgggttatccttaaggagcttcgtcaaacgatgcccgtccattttcggcatctcaatgtcactgataatcatgtcaatatgatctgacaggtttgctccgttatccgtcagttccacgacgtaatcatacgcttcttttccgttttcaaatgtaacgatttcactgtaccccgcctcagtcagctcatccgtcaaaagacgcatcagaagcggcgaatcttcaacgatgatcagttttttacccgcccgtctttcatcaaatccttcctgatggacatgataagtctcaactccggatgccgattcaatatcgtaaatgatcttttcataatcaggcagaaagatcatcgtgtcttccagtttgatgattcccgttaaatgccgctccatgccctggttcagggaagtcggcttttcaatcgcctcccaggacaccctgtggatttgtgaaacggaaccgacgtgaaagacgattttccgcttgttgaattccgttacgatatatttatcgtcttttgctccttcggcatcaacgccgaaaaaggaatacagactgatgacgggaagaatttcgcctctcagcttaatcatcccttctacgtctttatgagactgaggcacagatgtgacatctaccggctgaatgatttcccggactttcatcacatttatgccaaatgtattgacgcctacttcaaatttgacgatttctaattcgtttgtgcctgaatccaataaaatatcgtattgttgtaaagacaattcaatccctcgctatccgcattcagtattgtactgtatatatcggctgtaaacggaaaaagtgaatgtattcgggccaactggccatgaactctttataaaaagatgcttttttctgatatcccattgactttttgacatcgagtggtaaaatagtcaaggatttttcaggaagaagggtgtaataaatgggtacagtagtcatattcgaccaagatcaaatgacggtgttagaagatatcagcaaaacggcttacctgcaaatgaaaaaagaggcgaaagagcgtcccgacaagcccgctccatacatcttatggcgggaagacgtcagctttgaatacgggtattaatgacattcgccacatatcacaatagatagatcatgatacaatgaagacaatcatttcagctggttgtcttatttttttctgaaaaaaggtatgttttcacatatcggacatatactcgggatagttcaataaaaagatgacaaatgctcagctagtggtaaaataggataaactcaatatatagtataaggtgatgaattatggaacatttgcttaatccgaatgtaaaagaaattgaaatttcaggaattcgcaaattctcaaatcttgtagctcagcacgataatgtcatttcgcttacgatcggccagccggatttcttcacgccgcaccatgtcaaagcggctgccaaaaaggcaatcgacgagaacgcaacggcatatactccgaacgcgggcggccttgagctgagacaggccgtacagctttatatgaagaaaaaagctgatttgaattatgaggctgaaactgaaatcattgtcacaaccggagcgagccaagcgattgacgcgtctttgcggacgattttatctccaggcgatgaagttattctccccggaccgatatatccgggctacgaaccgatcatccgcatgtcgggcgccgttccggttcatgtggatacgacgacacacggatttaagctgacggcgcggcttattgaagaatcgctgacaccaaaaacaaaatgcgtcattcttccttatccgtcaaatccgaccggtgtgacattgtctgaggaagagctgcaaaacatcgcagccgtcctgaagggcagaaatgtttttgtcctgtctgatgagatttacagcgaattaacctatgacagaccgcattattcgatcgcgtcttatttgagagaccagacgatcgtcatcaacggcctgtcaaaatcacacagcatgacgggctggagaatcggtttcattttcgcaccgaaagaaattgccaagcacatcttaaaagttcaccaatacagtgtgacatgcgcgtcttcaatctctcagaaagcggctcttgaagcggtgacaaacggtgttgatgatgcgcttattatgagagaacagtataaaaagcggcttgactatgtatatgaccgtcttgtttcaatggggcttgacgtcgtaaagccgtcaggcgcattttatatcttcccttccattaagtcattcggaatgtcatcgtttgattttagtatggctcttttagaggatgcaggtgtggctcttgtgcccggcagctcgttttcaaagttgggtgaagggtatgtgaggctgtcattcgcatattcactggatacattgagagaaggcttggaccggctggaagcatttattttaaaaacgagagaatccatgcagactatttaaacaacggcataacgccgttgttttttttattgtttcgggaatgtaatgtgaaaggccgtgcctctgtccggtttgctgtctacttggatggctccctggtggtttttaataaggttgaatgtgaccatcagccccaggccggttcctttttctttcgttgtcaaaaacggttcgcctattcgtttcagcacgttttccggtatcccgtcgccctcgtctttcaccgtcacattaacggaatactcatcttctgtcatgatgatgtgaaccgttcccccatccggcatcgactcaacggcatttttaatcagattgataaacacctgtttcagctgattttgatcaccgttaatatacatgctgtcatgttcgtaatccgttttgataaaaatccctttaagattcgcctgcgtctctaaaagagcggtcacttcacttataattttctttaagtttacacgctctttcacggcgttttgctgaggtttggcaagcattaaaagctcacttaaaattaattcgattctgctcagttcggaaaacacaatttcaaagtaatgttcgttttcctccatcgtcggcttcatgagctgtaaaaatcctttgatcgccgtcagcggattgcggatttcgtgagcgatccccgccgccagctgccctgcgatagacagcttttccgacttcagcattaattcctccgtctgcttccgctcagaaatgtcacgcagaatgacctgcacggccgtttctccgaaaaacgtcgtcggaatgcagaccatttccgtgtagatcagccggtttttaaaggtaaaccacgattgcttaatgatttctgactcggtctttcggttgataatattttggatccgctgtttcacgccgtcatgatcacagggatgaagctgatcatagacgtttttcccgattaaatcttcatatgtttcagcctcaaacagcgaaatgcccgattcattcatgaatacccacttatcattgtgaatcacggcgatcgtgtcaattgaattctgaatgaggagctgataacgctctctgcttttttgcagaatcgtttggaattttttccgtgaagaaatatcaatcagaagcagcaattccgcccgctgatttttatatgtcgtcggtgccgccttcacttctaaatgaacgggcgtgccgtcgagccttctccacgtctgttcgatcattccgacttccattcctttttgcatccgcacaattcggtttttcacaatgtcgtgatactcttcttcaataaactcataggagcgcctgccgattacctcgtctttgctttcggctcccagcatggcaagcatcgcgttgttggcgtaggcgattgtgccgttgatgctgacatataaaggattcggcagcatttcaacaagacgctcgaattcgccgtttccagccgcatcttccgactgttgttctgccttttgcttcttttgttcatacatataaggccggcggggcgtcttctcctcaagcaccttgattttgaggatgatttcccgatccgtcccctccatttgcggtgtgacaatttccacacccgcttcaagccatacgatggtatgatcttttttaataagacgaaaggtgcaaggcatcaaatgatgctcattatagaagtaactttcaaccaaaaattgatcttcttcatgcaggaacgttttgagaaatgacccgatcatctcttcctgagaataactgaagtacgatttacagtttgcggaaatatacataatacgcccgttagacgtcaaaacggcatgaagatcggttttcgattgaaactgtttgacatgctgagtatcctgttccacagaatccctcctttgcattatactcgcactgcaggctggacacggactgatataaaaagaaattccactagattgattcgctaaaaaatgagcattctccttctattcttattgtgaacgtcaattttcctgaatgaaagaaagggcgcacgagatgttcggccgccctttcatttgttattttttattgtatttcttttcaagttctttgtaagcgtcaattgctcccttagcaatgtttttgcttacatgatctttatcatttccaacagacggaacgacgacgctgaatgccactcttggatgctctgacggataatagccgacaaaggtcaggttatacgtgtacttcccccaccagtttttgttcgtgccgtaatagtgcgtctccgcggttcccgtttttccggaaacatcagcgccggaaccttggaatgttgaataagccgttccttgaggtgagcttgtgaccaatttcattcctttatgaacttggtcaaaatcgctcggactgttatttactttgttcaaaattttaatatcccgctgttcaatcgcttttccaatcttatttttgctgtccggttcatgaatgcttgtgacgatccgcggctggacgcgatacccgccgtttgcgatggctgaaatatattgagccatttgaagcggcgtatacgtatcaaactgtccgatcgcaaagtcaagcagcaatcccccgaccatttgcggatttgactgcatgcccgctgattcctgcggaagatcaatcccggtcttcacacccaaaccgaattgggcgtagtagttgcgcatttttttaatatcgtctaatccggcaggcagcgtgccgtacggcctgtaggtaatgccggcgatatgcatggccacatgaaacatatacacgtttgaacttctttgcagcgcggtcagctcagtaatggctcccatttgtgtccacgattgttttctcgttttgcctttaaatacaagcggtgcatcgacaaacgttttataatgcgggaggccgctttggtaacccgcgagaacagtcgctcctttaacagaagagcccatctcatattgggtcgtaaatgctccgatcgcaaaatcctgtgttttatttgtttcgagatcgatgcgtttccccgccattgagagaatatccccgttgttcgggtccatcatgacggcaaatcctctgtcaaccatatagttgcctgcggcgcggcttcttctcagctctttttcaatgactttttcgactttcgactgtaattccatatcgagcgagagttgcagatcgtagcctctgctgccttcatcgacgggcttttggctgacgacctcacctttgctgttttccacatactctactttttctttatgcgcgtttaaatagtcctcatactgatattcgatgtagctttttcccacccggtcattcagtgagtagcctcttgtgacatagtaatctttccgttcgcccaacaatccctgttccggtgtcgtcacaccgccgaacagagagtacagcgttttgtcgtatggatattttcgcgtccagtcattgatcacgtcaatgccggggagctctttcaggtgctcggatacgacggaaacttcttcatatgtcagatcgctttttggtttttgcttgttgttttcatgctcgtcaagcaatgaaccgctgtttccgtttccgttcagcttattcgggtccattgatttgacgacttgcggctgataggcgttgccgcttgaaaaacgcgtataaatcgccgcaatttgcagctcttttttatcttgtttgatcgcatcaatctcctgcttcggaacgcgttcaatctggcgtttgtacacttcttgggatttcaggctgttttctgaatccttcataagcttttccgccttcttcggatgtgccgcaagccagtaatcaatgatatttcgatccttcataaattcagtatcaatatgaatcagtgcggcgagattttttgccgttttcaatttgtcctttgccgaggtttttgaggtagaaacgtatacaatttcaggcacagcctggttatcaaccgccaccctgttccgcttgtcatacatttttccccgcggtgtcggataataggcggtttttgcatttgccttctccgcatcctggcggtgtttatccccttcgacaatctggacgatgccgagtttaaaaatcagtgccgtaaagagaagaaacacaatcaaaaaatagagattcattctcagcgctctgtaacgtttcgtttttttctttggttcgcgcgcgacttcagccactttctgttacacctctcaaatcattgaatatatttacataaacagattttaattgtaacatttttgtaaaagttgttacagcgaaaacgggtaaaaaaaactgtcaagatcaaattatcttaaaatatatctaacacttcaaataatttgaagagatgtaacggattttaaaaaataaatacagatcgtttttactgatataaagccatttttctgtgctcaattacaattatgacaaacgtttgttgtcaaaggaaatggctgcctgcattatgacaaaaaagctgtgataagatttttcatgtagaaaaaaacaacttctctgggaggctataaacttatgaaaaaagcatttctcttatctgccgccgcggcagtcagtttgattacattcggaggcattcagcaggcatctgcaaaagagctgtcatgccagcacgtcgttactgtgaaaaaaggaaacaccgtacagcatctgactcttcaagaggctgttgaaaaactacatatgaaaacgagcgtgaaaaagctgaacgttaaaaatgagaaagaactgactcagctgctgcaaaaacacgcaaagcattctgatatgacagttaaagacgttcaaaaagaaacaccggaaaaaacggccccgacagctgccgaaaaaccgaaagccgatcaaaaccagacggctgacaatgcaaagcagacagataatacaaacaacagcagcgagaaaactccttcatcagtcagtgcgtatgaaaagaaagtcgttgaattgacaaatgcagagagacaaaagcaaggcttaaaacctctgcagattgatgaaaaattaagcaaatcagctcacgcaaaatcacaagatatgaaagacaaaaactatttcgatcaccaaagtccgacttacggctcacctttcgatatgatgaagtctttcggaatcacttataaaactgccggtgaaaatatcgccaaagggcagacgactcctgaagccgtcgttaaagcttggatgaacagtgaaggccacagaaagaacatcatgaatcctgagttcactcaaatcggtgtgggttatgtagaatcaggaaacatctggacacagcaattcatcggaaaataaataaaaaaagattgcccggcgggcaatcttttttttatttcacccaaagcttataaatgctttgagttccgctgttttcttcaccttgcgcggaaagcttgtcgtacaatgatttggccagcgccaatccgggcatttcttctcccatgagctccgcttcttcaagggcaatgcccatgtctttaataaagtgtttcacgtaaaatccgggcgcaaaatcgcctttcagcatacggggagcgaggtttgacaatgaccagctgccagccgctccggttgtaatgcttttcagcacttgttccgggttcagaccggatttttccgcgtaagccatcgcttcagccactccgaccatccccgctgcaatcgcgatctgattgcacattttcgtatgctggccgctgccagccggcccttgatactgaatattttcccccataacggagaaaagcggcaggcatgcttcaaacgcttctttttctcctccggccataatggcaagcgttccgttcctcgcgccgatgtctccgccggaaacgggtgcatccagggcgtgaatggacttttctttggctttctccgctattttcttcgccagagatggttttgatgtcgtcatatcaatgacaaacgccccttcttttgcatgacggagaatgccgctttcaccgagatagatttcctcgacatcactcggatagccgaccatggtaataatgatgtctgctttttccgaaaggtctttgaccgtctcctgccagaccgctcccttattcagaacctcttccgctttgtgtttcgtacgcgtgtagactaaaacaggatagcccgcttctaaaatgtgcgatgccatactgtttcccatgacgcccaaaccgataaatcctaccgttttgttcactgcgctttcctcccctgatgcgattcatatatcactctttcatgtctatattaccatattataggctgatagagaccgcgtcacaaggtgaatttagaaatggcgctgatcagatcttcgcttgcgctctttaacatatcagtcgattgcttcactttttcaagcgtaacgagctgttcatcagtagaagcattcacttcttccgccgctgccgcagattcttgagaaatggcggagatgctttgaatcgcttcttgaatcgaggcttgttcttcactcattttttgaatgtcattgtaaatatgatctataccttgaacgagagactgcatttccgttgtaatcagattgagaacctcacccgtttcatgaatggcgctgttttgttcatcattcattctgcttgcctcaatcatcgcgtgtgacgcttcttttgtctcagattgaatcagacggaccgtctcactgatatggccggaagaaagagctgattgttcagcaagcttgcggacttcttccgcgacgacggcaaagccccgtccgctttctcccgctcttgcggcttctatgctcgcattcagcgccaagagattcgtctggtctgaaatagcggatattgccgtcacgacttcttctatgtttttcgtttgttcttccaggtcattcagcattgcctctacttttttcgtttctgaattggcttcgtttgacttcatcagcagctgcccgagcgcgtccaatcctttgtagctggcatcctctgaagattttgagagttgttttatgctgcctgcgcgatctgcgattccttttattttgactgagagattttctgatttttcgttgatcgtctcaacctctgacgcttgctctgtcgctccggcggcgacttcctctatcgcttttgcgatttgtccgctcgtttcatttgtttcttgtgaaatgacggttagctggtcagatgtatcagacacattttctgaggaggccttgacctgttcgaccatctctttcatattttcaaccatttggttaaagtcttttgttaactcgcctacttcatcttttgatttcgtctgggcgcggacggttaaatctcccgctgagactgaatttgtttttgcgatcagctgctgaatcggcccggttatcgtttttgcgaggaaatagctgagtccgatcgtaatcacaagggcgatcagtgacataaaaatgctcaccgtgttcattttgtcggctactcccatcagctgatctttttcaaactgcgttccgactttccaccctgtttcttttaccgtttggtagacgaccatgttcccctgcagctctttgatgccttctttgtccgcagtgatgtcttttaacgtctgatcttccgaaatattttttccctgttttgccggatgggccagaagagagccgttttcatccgccaaaaacgcaaatcctttatacggaaccttttgctcgttgaccatgctctgaatggaggacagcttcaaatctaagctcgccactccgacgacggttccgctgttttgaatggcttttgacgccgtcacgatcatgtctcccgtcactgcatctttataagggtcagtccagacaaccttatcgggtttttcagccgccatcttataccacgttcgatttgtcagatcatagtctttggcaaaatcggcctttggatatgtaaacatttgtttgtttgcggttccgacgtacgcaagcgcgacatatttgtcattctgtccgatctgttttaactcatcgttaaaaagccgcgcggtttctttcttcccatctgatagaaaagaccgggacaattcaccgtctgctaatctcattaatacggtctcatcatttttcagctgaagctcaatgttctgaccgagtgaattggtgacattctctgtcgtacgttttgcttcctccgtcatcatcggctttaatgtcaaatatgaagaaaccgttaaaaaaacaaccgttacaataagcattgccgatacaaacacagcaattttgatatgcatttttttaaacataaccatcccctcctgagagttatatcggtctttcggccaagaaaatgaataaatcttgaaataaatatcaaacatttccgtcatttgtcgcagcaaaaaaaagagccgtcatgccgacagctccgccttacgtaaaatattcgattttcgctttcggaaaataggtttcgatataagattcgagtgtttcccttaaggcatgttcttcgtctttttggtatatatatttgccgattccgtagcgtccccatttgtacctgcgcttttcttcatcaagctcaagctttgttttcggatagttcttctcaatcacccgtttggccggttttgtaaaacgatgctggatcagttcaaatgtgatgtcatgccgaacgtcttcatcaagcgccgcatccagtttctcaaacagctccttatagccttcctcccagccatcatgaatataaataggcgccacgatgaaaccgagcggatagcccgctttagcgactttgacggcggcttcgatccgtttgtcgagcggagaagttcccggttcaaagttttttatgacataatccgcattgatgctgaatctgaacctagtctttccgttatgttttgcatcaagcaaatgatcgacgtggtgaaatttagtcacgaatctgagctgccccaattcgctttgtccgaaatgttcaatggctctttttaatgtatgtgtcagatgatcgattccgacgatatcagacgtacaagaggcttcaaatcttgtaaattccggcgctcgttctttcatatactcatcagcctgatccagaatctcttctacattgacatatgtccggatgtaaggctttgaccccatcgtcgtctgcaggtagcaatagtggcaatgccccatacagcctgtcgcaaatggaatggcatattcggcggacggctttgaagaatcgaatttcagtgttttccggacgccgattaccaatgttgatttcgcgttccggtattgctgcaagtgatttttccccggaatattccggacttgattatgcgatgttgtttctctgatctcaagccccatattttcaaacttattcttcagctcttgtcctaacgggtattcgagcgctctcggttctatataaacaagctggggcacaaacggcttcagcatgaactgacactcccttttttcatattctcatgttgttactttccgtttaaaagagagtgaatatgcgttgtaaacatttcctttgatcaatgatatcggtcttcttcaaaaagctcgctgtaaagcgcttccgcttcctcatatgttgaaaagaccgcgtcatcttcggccagcggatgataggtttcgtataaaaacagagacagttctccctcatgatatgggtgatggacgatctccgcctctttaatatgggcaacattggcggcatgcggattgcggtaaatcacatagaccgtatcccccgctgcaaatgattttgtcataataatccctcctgttgaacgttattgttccccccttttttccgaatatgaaaaaaaccagacggcttataccgtctggctgttgtattacttattgaatgtttctttaacgaatgcgacaacctcttctgtcgtgctcatagacaagattgtttctttgaatgattcagcttcttttttagaaagcttgctgatctgcgttcttgccggaaggatggatgtagcgctcattgagaactcatctaagcctaagccgagaagaatcggaatcgcaatttcgtctcccgccatttctccgcacattccgacccatttgccctctttgtgagcggcttcaataacaagggtgatcagacggagaatcgccgggttgtatggctgatacagataagctacgcgctcgttcatgcggtcagcagccatcgtgtattggatcaagtcatttgttccgatactgaagaagtcaacttctgtagcaaactgatctgcgataacggctgtagacggaatctctaccatcataccgacttcaatatcgtcagaaaccgctacgccggcttcgacgagtttttctttttcttcgagaagaatcgctttcgcctgtttaaactcgtttactgtcgcaatcatcgggaacatgatttttaagtttccgtatgtacttgcacgaagcagcgcacgaagctgagttctgaagatttcttgctcttcaaggcaaaggcggatggctctgtagcctaagaacgggttcatttctttagggagctgcaggtaaggaagctctttgtcgccgccgatatccaatgtccgcacgacaactgattttccttccatacgctcaagaaccgttttataagcgtcaaactgctcgtcttccgtcggaagctggtcgcgtcccatgtaaaggaattccgtacggtaaagccctacagcttctcctccgttttcaagaacgccttttacatcgtcaggtgtgccgatgtttgcggcaagctctacatgatggccgtcttttgaaacagtcggttcattgacgagcttcgcccactcagctttttgcgccaggtaagcactgtgcttttcttcatatttctttaacgtttcactggaaggatcgatgatcacatcaccatcgatgccgtctacgattaccgtaacaccgttttcaattgtccctgtagccgcttttgtgccgacaacagccggaatttcaagcgaacgggccatgatcgcggagtgtgaagtgcgtccgccgatatcagttgtaaaaccttttacaaactggcggtttaattgcgccgtatcagacggtgtcaaatcttcagccacgataacaacctcttctgagatcatgctcgggttcggaatttccacgcccagcaggtgccccgtcacacgttttgttacgtcacggatatccgccgcacgctctttcatgtattcgttatccattgattcaaacatagtaacgaacatggaagctgtttctttcaaagcgaattcagcattgactgaatctgtgctgattttctcctttaccgggttcagcagctcaggatcactcagaactaaaaggtgcgcggagaaaatgtcagctttgtcttgtcccagttcttttaaagcatgctctttaattttttcaagctcttctttagaacgtacaatcgcttcatcaaaacggcttacttcagccgcagcatcagcaatgtttttcttttcaaccgttaagtccggctcttcaagccggtatgctttcgcaatcgcaattccggctgaagcgcctattccttttaattcttgcattactcgccgagtccttcgcttttcattgtttcttctaaagcgttaagagcatcgttttcgtcagcgcctgaagcggaaattgtgatttcagcgcctttagcgatacctagagacataacgcccatgattgacttaaggtttactgttttgccgttatattctaagtttacgtcagcatcgtatttgcttgcagtctgtacaagaactgtcgcaggacgagcgtggattccggaatctgctgttactttaaatgttttttgtgccatgattatcattctcctttaaattaaagctattttactacacaatattatatcatacagccgtacttgtcatctgacaagcacggcgtatttatatgcttattttccgattttcacaatatctttttgttcccgttttacggtaccttcggccgaaagggaaatcgcttcaccctcggcaagatttgtaaagacaatcggtgtcattaatgaaggaacatgaggtttaaccgcttcaagatcaacttcaagcagcttttgccccggttcaacccggtcaccctctgaaacaaaagaagtgaatccttcgcctttcaggctgactgtgtcgattccgaaatgaatcaggatctctcttccgccgtcagactgaagaccgatcgcatgttttgtcgggaaaacattcagcacttttccgcggacaggcgatacgacgattccttcttcaggaagaatcgcaaaaccgtcacccatcatttttcctgagaacacctggtcaggcacatcggtaatcggatggatttcgccggtgatcggagaagcgaacacttcttcaccctgctcgtttcggagcggatctgcgataacctcctcaacctgctggctgacttcttcttgtgcggatactttcggttcagggcgcggcgtgcgtccggcgataatatcctgcatctgtgtttttaaaccgtcagaacgcgggccgaaaatggcctgaatgttgtttccgacttcaagaacgcctgaggcgccaagctgtttcaaacgagtcttatccactttcttctggtcgttgaccgtaacgcggagtctcgtgatacaagcgtcaaggtgcttaatgttttcctggtcacccattgcctgcaggatttcataaggaaggtcgccggcttcgcctgaggcgcccgcaccttcatccgcagcctcttcttcacggcccggcgttttcagattgaactttctgatcgcaaaccggaaaccgaagtagtaaataacggctaatcctaggccgaccggaatgacaagccaccaagcggtccggttaggcagaattccgaacaggaagtagtcaatcagaccgcctgagaacgtcataccgatttttacatgcagcagctgcataaccataaaggaaagtcccgcgaatacgcagtgaatcgcaaacaggataggagccacaaataagaatgagaattcaagcggctcggtaattcccgttaagaaacttgtcagagcggcagaacccatgattccggctacaagttttttcttttcaggcttcgcttcatgatagattgcaagcgctgccgccggaagaccgaacatcataaacggatatttccccgtcataaatgttcccgccgtcagctgtacgccgtctttgatctgagccatgaaaatccgctgatctccgcggatgatgtctccggccgcatctttatagctgaaaaattcataccagaacggcgagtagaaaatgtgatgaagaccgaacggaatcaatgaccgctcaatcatcccgaaaataaaggccgccaaggttggattcgcttccacaagacccgtggagaaggaattcagaccgtgctggatcggaggccagatcactaacataataagtccgagaattaatgcggaaattgatgtgataatcgggacgaaccgcttacccgcaaagaatccgaggtactgcggaagttcaattttataaaacttgttgaacaataacgcggccaggaccccgacgataataccgccgaacacgccagtcgccaaagtgggtatccccagcatgttaatataggccggatggttttccgcaaaaaactttgcccgttcaattttgtcagacggaatactgccgttcgccataagcacggcgctcatggatacgttcatgaccaggtatccgataatggccgcaattccggcaacaccgtctccgttggcaagaccgatcgcaacccctactgcaaaaagaagcggcaggttgtcaaatacgatttggccggcgctttccatgacgttcgccacaagctgaacgttatcattgcttaagaaatgcatgacttgaatcatatctttgttctgcatggcattccctaacgcaagcaagatccccgcagccggtaaaatcgcaaccggaagcataagagcacggccgattttctggagaacgccgaataatgctttaaacataaaagatgtacctcctctgttagctagtgtgaccttacagcgaaaattcatgacaacgaattcactggcgcaagtcttcagtttaaccgtttacatttgcccttttacacaacaaaaaaggcatgagtaaaaagggtgtgcaaaataacgggatcgttcttcccgttttttaccctcaatcactcatgcctgatcgaatcagtgacacgtttttaaggtttcaactgaaattatgaaattttattggttaatcggtacaaatgaagcgtgagataaaccgcttccgcctcatgaactggttttttcagtatttgctgcaagatttttatcagtttccaagcagtattgtagcatagcgggtattcatttttcaataataacattaacttttctggttcttttgtctgctcttcccgattaatcctgtctatggtaaatctgatatgccggatcagccgcaaatagtggacgctttctttattcactttcatctggaaagagtcctcaatcacctgaacaaggcgggacatcagctgcgaatgctgattgacctctgaaaggggccgattcgtcagggcggaatggatatgcagagcgataaagccgatctctccttcaggaaggcagattcccgtcttttcattaatcatgccgacgacttcacgggcaatttggaattcttccggataaagcgtttcggtttccatgagaaacgggtttttaatgtcaaacccctgctgcagccgctttaccgcaaaggcgatatggtcagtcagcgcaatatggatatgctcatttaacggttggcttgtccgcttcttgatatgataaatgacgtcattggagatgtcgacaagtgtctcgtccacataaccgaggagctttttaaattgtttttgttctttttcatcctttaagatgaacatcttgtcataccctttatcttcaatgacatccgcttgtttttttccaaagccgatcccttttccgattaagacgacctcactgtatctatcatgtgttgcgatgagcacattgttatttaataccttttcaactgtaaaggaccccttcatgatcctcagctcctttgtcattcaatacctcatatcgtacaaaacgaacggaaagcgcgtcaattctttttttagacggttgatcgttcaataaggcggtaatcaagaactttccttcccggaggcccgccgctgatccggttctcaagcatgtgaaaagcctgctttcccatttctttcgtttgtatatctattgtggaaatacctaacatcttgctgatatcatgattgtcgatgctcaaaatcgcaagctcttccgggatgcgcgtcccgtttgccttggcttcaaggtaaagacctgcggatacttgatcattcgccgcaaacagcgcagtcggtttgtcatcccagctcttccatctatgaaaaagggctttcccgtcaagcagcgtcagcaccttttccacaaccagctcttccctgtaaggctgcccgatcttcttcagcgcctctttgtatgcggcgattcggacttgactgttttttcccttttttctggccaggcagatcgctattttccggtgtcccttttctatcagataatccagaccgtgccgaaatgcttcccgatgtggattactgatggaggaaagccctgccgcatcagtgtactggcagaggatgagcggttctttcacggcaagcaaatgctcatcaggaattgctttggagcagataatcaggccgtccacttggcgctcctgtaattgtgataaggcaaaacgttctttttgctgctcataatctgtctggtataaacaaagatgcacgcctgacgcttcggcagcctcggcaatacctgcaacaaggtctgcaaaatacggaaggttcaccgacggaagcacaacgccgatcatatcggaaaaacctttggataaatgaacagcatgaatgttgcgcgtgtatccgagcgattgcatcgcttttttcactctttctcttttgtccttacttacataaggatgatcgtttaaaactcttgataccgttgtaacggaaaccccggcagcgccggcaatgtctctgatcgtagccatggcgtcccccctttctttttttcccttgatctggaatgcgtttcatacagtaagctagaaacagatacatcctatccgtttgaaaggagaagaacagcgatggggattctttgcttaatcggtttgtgtctggccatactcggcggcagttaccttgccctgcggcccctgaatgaaaagcatgacatcaaaccatttcagcattttgatgattttttcatttaaaaggtgataaaaaaggacgctgcgttccagaaccgtccttttttatcacaaagctttctatttcagaatcgttaattctttcggatactgcgttaatgcttcggcgccgtcttttgtgacaaacacatcgtcttctatgcgcacgccgccgacatccggcacgtaaattcccggttctatcgtgtacaccatgccttctttgaggagtgtgtcgttcgcgctgctcattgatggatattcgtgaaccgaaatcccgagtccgtggccgaggcggtgcgggaaatagtctccgtatccggctttttcaataatgccgcgggcttttaaatcaagatcgccgattctgacgccgggtttacttaattgaagcgccgtctgttcagctttaagcaccgtttcgtaaatctcttcctgtttcgggctgattgattggtatgcgaatgttctcgtaatgtctgaacagtagccgtcaagaataacgcccagatcaaacagaacaaaatccccttttttcaaccggtctgcacccggattcccatggggctggcctgatttttccccgaacagcaccatcgttgaaaatgacatgccctgcacaccttttttcttcagctcaaactcaatctgcgcgagtacttcggtttcactcacaccctctttaagcgccgcgacaccgacttcaactccgtaatccgcgagttttgccgcttccctgagaatgctgatttccttctcatcttttacgagacggaattggttgagcgtttcttctgccgaaacaaatgccgcgcccccagaagcttgtttgagctgttctgagcgggaaagagagatcgaatccttttcaaccgcgatggaatcaagcggcacatttcgttttgtgagctcggctttgatcagctcccacggatcttcgtgatcgccgtagccgataataccatgctcccaaccggcgcttcgggcttgtccgtcttccattcccggacaaacgaaaaacggctcctgttcctgaaacaggaacaatcccattaaccgctcatgcggatccgtgtaaaaatcagttaaataaaatacgttttcctttgtatgtataaacgccgcatcatgtccttcttttttcagccaagatgaaacacgttctaatctgttcattttttgattttcctccttaccaaagtgactctttattcattctatcagttttccggcgtttatgctgtgaacgaacattaaaaaaacagccgcccgatgtgcggctgtcatgtttattttaataatctcagtccgttcagtataaccagaatcgtgctcccctcatggccgattacgccaaacggcagttccatcacctgcagaaagttagcgcagatcaaaaggcagatgaccgagagcgagaaaacaatattctgcttaataatccggttcattttccttgaaagtctgcacattttcacaagcttgtgaagatcatttttcataaggactaagtcagccgtttctagagccacgtccgtgcccccgcccatcgcaataccgacgtcagcggttttcagagcgggcgcgtcattaatgccgtctccgaccatggcgattgtgccgtacgtttctttcagcttcttcacttcttttgccttttggtccggcagacaatcggcaacaaccgtcgtcatgcccgcctctttcgcgatggcagccgcagtttcagactgatcgccggtgagcatggctgtttgaatgcccagtgattcaagctcagccatcacggctttggcttcaggccggatttgatcctttaaggcgaagcagcccgcaatccggtcttctttcttaacaaaaaccagtgtaaagcctttatcctttaattcttttcccgatgtctgcaaaaaagcatctgccgcatgttcacctgcaaatcccgcttttccgaccatccatttgacgccttctatttcagcctgaacaccgaatccggacgtctcgtcaatcgatagatggcctgcgggcgcggcgccccggctttcggcaaattcagctatcgcttttgcaagcgggtggcttgattgcttttctatcgcatataccgcctgcatgatctcatcttcactcacattttccgctgcttgaaatgccgcgactgccggctgtccctttgtgaccgtgccggttttgtcaaatgcgatcatccgtacgcttcccagctgctctaaaaacacacttcctttaaccaataatccgttgcgggccccatttgagataagggaaagcgcagcgggcataatagaagcaacaagcgcgcacggggaggcgaccaccataaacaccatcgcccggtaaaaggtttcactccagctccagcctaaagcgaaatgaggaacgaataaaagcacagccacggctaacagcacgcctttgacatagacactttcgaatcgctcaataaatgcctgagccggtgacacgctgttttgggctgattccaccagccggatgatttttctgaataaagactgttcatttgttttcgtcacacggaccgttaaggagccgtttccgtttaccgttcctgtaaacacagaatctcctgctgttttttccgccggcatcgcttcacccgtcagcgccgattcatcgaggctcgtcacgccagactcaataatcccgtctgccgctacgcgttcgcccggcttaatgacgatcatgtcaccgatcttaagttcagcagccggcacccgcttttcccgtccgtccgcaagcagggtcgcttcctccggttccagtttcatcaaggatgttaaatcacggctgcttttattcatcgtatatgtttcgagcgcgccgcttaacgaaaaaataaagataagaactgcgccttccgcccaataaccgatcagggcggagccgacagccgcaaatatcatcagcagttccacatttaacgccttcgtctcaatggtatcctcaattccctcttttgcttttgcaaatcccccgatcaggaaggcaaggatatacaaagtgacggacaggccttttgtttcggtaaaaaaccaggccgcaagaataaggacgccggatacgagcgccgcaatgagttctgcatgctggagccacctttttccggcccgctcttcttgtatcttctgctgttgtgaatgggtttgtgtcatcacttgttcattcattatgaattctcctctctaattgagaacgcaaatcatcttcaattccctgataaaagtaaaacagccgcctgacaggcagcattttcacagtgttatcgcagtgttttctttattatagcatgccggcggaagatttcaattataattgttttaatttctttatgataataattatcattagtgtttcttcagctgttcattatatgcaaaaaaggtgcgggaggaattcctcccgcacctttttatttctctgaccattcttttaattgtgaggcggtcatcggaccgacgatctttttttcgatttctcctttttcattcagcagaaatgacgtgggaatcgtcatgacatcgtattccttcataagctcgcctttcgtgtcaagaacaatcgggaatgtgagatggtgctgagtgacaaagttttgaacggtatttttatttcgctcggcattcatcaaatttaccgttacaaggcttacatcatcagactgatgctgttcaaaataggtttggaattgcggcagttcttttttgcacggcggacaccacgatgtccaaaaatgcaaaatcgttttctgccctttattcggaatcgatatttcgtctccttcaatcgtcttcatcagaaacacggcgggaactgcctgtttttctgatgaggcttttgcttcaggcatccaaacggcggcagctatcaaaaggactgcacatacaattagacggtttttatgcatatgatcttcctttcacgcgtttcggatagcttgcccttccttattgaaatgtatcagccttttcagctttcgatccggggagctgttcttccgccgcccgtcaaaaacacggagacaccgaggtctttgcagatcgtcacgtaatgtaaacttgtcagaagaatcatgccggtattcataccgagtataatgccgagcatttgcaattccggcatagaaccgagcacatacatcattgaaagacctacaatgctgctccatacgttatgataaaacgccgttttcacgtggccgatgccgatcagacaggcttgaagcggcatcacaaacagatgaaaaagaaaaaacggccacaaaagctgcaaataatactgcgcttccggagactgaaaaaacaaatgggtcagcgggcccgcgaactgaaacatgacccagaccgccggaatgccgtagccgaatgtaataaaaatcgcttgtctcagccgtttcagcacaatatcatattgggacagcgcatacgcttctgaaatgctgggaatcataacgaccatcagcgaatgggcgataaatgcgggaaacgaaccgattgtcatcgctacaccggcaagcattccgtattgatcaatcgcggcggtcccggctgccccggacgccagcagcgctcctttaaccaagaagggttcaattgcgtttgtcaccgcatgaaatatacgaagtcccgttgtcgggatggatacggccaggaggcgtttccgcacgtctttcccgcgaagatgaatgtgctgatggccggaaagcgccctccgcgccaaaataaactgcgtatacagataaacgaacaccacaacatcgcttgcgaccagcacaaataacgaaataagcacggccatatcaatttcaaaagagtaccattgaaaaaagataaacagacaaagcacttgaatgatttttttcaagacattcgcaaccgcgatttttcccatttgctgcacacccataaaataacctctggcgatggatgtaaaagcgacgactggaatcagcccgatgacaatccctttaataaacgggtgatacgtatcgaatacaggaatgaacggcagcgcgatgcttgcggccgcggttgaaaacgcggtaaaaacggcggtcattctgaaggcatgccgaagcatgctttcatgcagcttctgattggattccgcgatgaattttgaaatagagatcggaagctccagactggcgatcacgataattaaaaaaatggtgggcagaatgctcatgtaaagccccatcccatgctcgccaagctcccgcgccagtatcatattcacgacaaattccagacattccgcgaaaaaggcggcgatggataaaagaatgatccctttcacaaatcgattcatggtgtctctccttgtctcacgttcttccatcatcatatgagacaagttctgaaaatattttcgatttctcaaaattgaaaaaagcatagcggggatattttttatcccgctatgcttcttacatcgcaaatacgtgtctgccgatccgttcgataatttttcgggaacggatccagtggtcagatgccgttttcggattgtagaaaaacaacgcgttcgtttctctgcccggatggtctagcgcctcatttgcggcggcgatggaatccttatccggcttttgattaatgcttccgtttgctaccggttcaaatgcattcctttgatagatcacgccccgaatggtatccgggaaaccgtttttttcagtacggttcagcactacgctggctaccgcaaccttccctttataagattcacctttcgcttctgcgtgaacgagacgtgacaggagctgtctgtcagcgcgggaatacgtttttttcggcggctgataagccgtctcgtccggttttgctttcttctcttggtgagatgacagctttatcggttggatagagtgcttatgatccgtttctgagagcttcggaaccgggctttttttatttaaatcagcaaccagtgtgctgggttcttgctttggcttcttcgcaaaagtaaacagagcttctgtatgttcaatttttgatgcaggcataaaacatagaaaaaagacagccaaggcagcaaattttgtcgtcatacgatttcctccttaaatacttcactaccttaacaagagctgtacgcaaattcacggttaaagattttccaatgctcccaatcagcttttatgatggaagaagtttgttaacagccttgttattggcaggaaaacagccgtcattttcacaacattaaccaaatagcagtaaaagtatccatcggagggattttacattttgtttacatctgttacagccagatgaaataagcagcgaaaacaaaaaaagactcctcaagtgcgaggagccgtcagcttcttggctgttctaaatactggaagataacatctccgccctgctgggcaataccgcggaaatgcttaaaatcttcctgcttcgacaaaaccgctcgaaatgcaagaaaatgttctttctgcaccctgaattctttgatttcaccgatgcgcatttggttgatacgttctgaaatttcctcaggcagcaacgaatacagcctccttttctcggctttttcccgaaaaacaatataccatctttcccccgccgggacaatgattgagcgggctgatacccatatcgctttacttcttaaagaaaatactgcaaaatattttcaaacaggatttatgataaaggagaggaagctcgtgaaaattgctaaggttggaaacgtcattgaatttaaaaacggattaaccggtattgttgaaaaagtaaatgaaaactccgtcatcgttgatgtaaccatcatggataattatcgtgaccttgaattagattccctcactgtcgtcaaccataagaattataaaatcatcagagactcctattaaaccccccgaacaatccgaaccatttacatatcccgcacaaaagctgccgcccggcagctttttcaaatgaattcagatctcggtcatttccacaaaaaaatcatcggtctcatctttattgtaaagatttgtgacggatgtatagtagttggttattttaccgcggaattcaagcccacgctcgggcgccttgatgtcaaatgttttttcatacaaaaggacggcaatatcatgatacgtttcagaggtcaccttcaatacgaatgaaatcatacggccgtttttacccgcactttctttacaatcatacattttcagccttacaccgtttaactctaacggctccataacgaacactccttctttttacaggacatgctaccatgctggccattcctttacaattgatccgctccgaataagaaaaaacagcgcagtcctttacaaacatacgttccctattttataatgaaacagacgagctgccatccagcacccgtcacgtattgaagcggcgagtacactccccccgggtttactcgtctttttcttttctccaaatgatctctcttttccttatagaagttctgtgcaaatatcatgcacctttttggctgcgtggcagagacgaaaaatacccccgcttaaaaggcggggtatttaggttatagtccgagtccgtactccgtctgaaattaacgattatcaatcgtctccggatacatatcatgattcatcatccgatgttcggccattttttcgtattttgttcccggtctgccgtagtttgtatacgggtcaatggagattccgcctcttggcgtgaatttgccccatacttcaatgtagcgggggtccattaattcgatcaagtcattcatgatgatgttcatgcagtcctcgtggaaatctccgtggttgcggaagctgaaaagatacagctttaacgatttgctttccaccattttttcatccggaatatagctgatgtagatggttgcaaaatccggctgtcccgttttcgggcaaagcgacgtaaattccgggcagttgaatttaacgaaataatcacggttcacgtgtttattcggaaatgattccaaaacctccggcgcatattcaaataaatagtttgtcccttgattccccaggagcgtaactccttctaattctgattcttttcttgtcatataaatctccctttctattaaactccccgtttattgccccaaagcagcgtatgcagctgaggcaggactctgacgagattcagatccgaatcggctgaaaccttatcaacgagtgtttcgtattttccgagcagatgtgcgatcaatgcccggtcgtccgtcgtatggacgttatcgtttccgacctgaagataaaacgggatattcggataccgcttgtgcacggttttcgcgaattgcagatcttcatcattaaaaatgacgacctttaagctgaccgcgttaagcctttctgccgcatcaagcgaagacataatatgatcgagctttgcaaaatcggttgtcatccccgaacttggcggcttcggtgaaatcgtcaggtcgttaatcattgtgaaccaatcctgatagactgttccctgcgtttctaaagcggcgcgcaccccgtgctctttcagcagcagaatcagcgcgtcaagctgctttaacagcgccgggtttcctcctgagatggtgacatgagaaaaggcgtctccgccgatttctctcagctcgcggtaaatgtcttccgccgtcatccagcggatatcttttttggctgatccgtcccatgtaaaagcggagtcgcaccagctgcaggagtagtcacagcccgccgtgcggacgaacatggttttctggccgataaccatgccctccccttgtatcgtcggtccgaaaatttctaataccggaattcctttagccattcctatcaccttttttcgggcggtatacgcaatagcttgtcggggtttccctgacaaaaacctgcacgcagaccggctgattctccagtgtttcgaggtaggactgcaccttatcataaatcgttttggctacgacctcggtcgtcggcagtgaatatctgtcatcatcagaaaattcctcatggtcattcagcaatgtatggtcataagcgccgtgcaccaatttcttcagcacgctgaaattcacgagaaagcctgaatcgtccagttcatcccccgcaactgtaatatttactgtatacgtgtgcccgtggactctgctgcacgctccggcgctttcgcggggaataaagtgcgcggctgaaatgtgcatgtccttattcaactcaaacgaataaggatgctgaacctgcgggtaaatttgagaaagcaattagttccgctctcctttcattttcatatattcatcatatcctttattgcggagcaggcatgccgggcattcgccgcatccgtccgcaatgatgccgttatagcaagtcagtgtgttattctttacaaaatcaagcgcgccgagctcatccgcaagtttccacgtttctgctttgttcagccacataaggggcgtatgaatgacgaacggcttttccatcgccaagttgacggtgacgttgcaggatttgacaaactcgtcacggcagtccgggtagccgctgaaatcagtctcgcaaacaccggtaataatgtggcgcgcgccgatttgatatgcaagaatcgatgcaaaggataaaaatacaaggttgcgtcccggtacaaaggttgtcggcaattccccgtccttcgcttcaatttcgatatcatctcttgtcagcgcattcggcgcaagctgatttaaaagagacatatcaagcaagtggtttttgacaccgagcttttcggcaatcgattttgccacatcgatttcttcttggtgacgctgattataatggaatgtaacggtttccacttcttcaaagttttgcaaagcccataataaacaagtcgtgctgtcttggcctccgctgaacaccacaaccgctttttcttttttcatgtctttctctcccttatctatcattccataaaaaaagcgcctttttcggagaaggcgccctaaaaaacataaaaaaaccgtatccaaggatacagctcgtccttagttttttatagagggtgtagctagaacctctcccgcatcaatacggattttcttcttttttcacttttgctatcataccataatgttgtttcccgtgacaataaaaaaacagcctgaaccctgtgtcaggctgcaaaagcgggtttaagccccgcgtttcttccccggaaatgccatcagcgcaatcccgatcagaacaaataaagcaggccagaaaacagaaaccggaatgatcggctgatacgtcatcataaagcaaagtgctgtcaaggtcagcactgcaaccggaatgagcagcgccttctgtttcccgccgaacagccacagctcaaataaaccgaatgccgttgccaacaggtaaacaggccatgtcacatcggagtagaaccaattggttgccgtttcaaagacaaacaagatccccgtgatcaataagatgccgcccggtacgagaagccccgcgtttttgacaggtttcgggccgaaaatcggaatgtgaaaagcggcgcccagcaacagaatgagagcgggccagccgcgttcgctgatgacttcatttgcattggtgaatatgccgaaaatgcccgcggcgcacagaaccgccgcagcagtcaaaagccctctttgccttctgccgaacagccaggcttcaaacagcccgaatgcaacggcaaagaggtaaacaggcgatgtcatcgttgcgtatgtccaatccgtcagcgtttcaaaccataacaagccgcccgtcacaagcaaaatgccgcccggaataagaaggcccgatctttttttcggttgcataaaggcagcggcgtgaaacaaaagcgcggctgcgatgatcaaaagcggccacagccccgtcatcagcataccggcaaagcatagtgctcccgcggctgtcaggataaaagcaggaatcaatacgccgatctttctcccgccgaaataccacagctcaaacagaccgagagcaggcgcccatatataaacaggccacgtcatgcctgaatacgtccatcccgttgcggtctcaaaacaaaacaggcagcccagcacaagaaacataccgccgggaacgagcagtcccgcctgttcaggcgtttttttcgcaaaaataaatccggcgtgaaaccctgcggacattataatgaaaagaaacggccacgccgaacctgcggatatatgtataactcccgccttctgtaaaaaaaacgtaatgccgatacaaataaaaataaatcccaataatacacgtcgatccttcatctcttactcctccccatcatttcccaattcattatacagaaatggcaggaaaaaagaagggaattcccaaaatatacagacattttccttatttttctttcgggatttttttgcaaatcaatgcgcccataaaagcgaggctcacatacccaaacaccggataaacggtggaaatcagctgtccgtaaccgatttggctgataatgaaagcaaacgccaaaatgccgccgtaaatatatgtactttttatatgaagaaaactgtttaattgtttttccaatccgtataaattgccgataaccgacgtaaacacttccccgaaaataataaacaaataaatgatatgaagcgaacgcgaatacgaatagacaacttgagccatcggaatgtcaaactccagcacatccggcagcaccgataatgataaaaagctcgcggcaagcaccagtgtcaacagaacgccgcctatataagctccccttctgatcaccttctctgaagacatttcgttcgcaagcggcacaaggacggcttgggcgagcgataaatttaacgcgccgtaagagacggcggacaaaagccagttccacttgtcaggccatacccattcgtccgcgtttctcgtgcttgtaaatacaaatgaatcagctgtcacgataaaagagaaagaaattaaaagcggcaccaccaatatattgacgccgaacacacctttaacaccgcttgtcatgacggcaaaactcagtacgatcgtcagtaggatccccgcttgtgcgggccagccaagctgttcatgaaacagcgctccggctccggacagcatgacagaggtcactcccagcaatataaacatcataaacatgttcacggcgcggccgatggactggccgaataaatatgtgttcaattcctgataagatgctgcatgaatccgtttggaaataatcatgattttggcgcctaaatatgtaaacatcagaccgcttaccacgataccgaacagaccgatccagccaaacttcagaaaaaactcaacgatttcccgtcccgtggcaaaaccggctcctacaaccgtgcctacgtatacaaatgcaagctgacttgcagaaccttttgtttgtcccatttcaccctccggctaaacgcagatttgtccaggcctttatatatgcttatgagacaagtctcccgaaaagacgaacaaatcgtccttccccggaaaaaacagattcagctctctcctctaagcaaaaatattgaaagaaaaaaagggccggcgtatactcttcatcaagaaaggtcaaagcatttcatttcctttccgactatattggtcaaaaataatcaaacctcacgaatatcacttatcatgctgtaaacatttatttttcggggtttgaaacaaaatacttgaaagtcaaagaaggtcagagtatactaataatcaaagaaggtcaaagtttcgaccttattttctaacccatttggtcaaagatgatcaaatatttttcgaggaggttttggcaaatgcgttgtcaacattgtcagaaaaacgaggcgacgattcgcctgaacatgcaagtcaattccattcaaaaacaattcgttttatgtgaaacatgttatacagaattaacccgaaaaccgtctatgagcatggggccgcaatcattcggattcccgtttgagcaaggtttcgctcccaatcaaaataaacagcaggccggccctgaaaaaggcctgcttgacgagctcgctcaaaacgtcacaaacggcgcaaaagcaggtctgattgaccctgtgatcggccgcgataatgaagtggcgcgcgtaattgaaattttgaaccgccggaataaaaacaatccggtgctgatcggtgagccgggcgtcggtaaaacggctattgcagaaggcctcgcgcttaaaatcgctgaaggcgatgtgccgaacaagttgaaaaacaaagagctttacctgcttgacgtcgcttctctcgtcgccaatacagggatcagaggccagtttgaagaaagaatgaaacaattaatgaacgaattaaaagaacggaaaaatgtcatcttgttcattgatgagattcaccttcttgtaggtgccggctctgccgagggatcaatggatgccgggaacatcctgaaaccggcgcttgccagaggcgagctgcaggtcatcggggcgacaacgctgaaagagtaccgccagattgaaaaagatgcggcgcttgaaagacgcttccagcctgtcatggttcacgagcctacaatagaacaagccatcagcattctggaaggcattaaagataaatacgagaaataccacggcgtcacattcagcaatgaagcgataaacgcctgtgttacgctttcatcccgttacattcaggaccgccacctgccggataaagcgatcgacttattagatgaagccggctctaaggcgaacctggaacttgataccgtaaatgaagaagatgcggctgagagactcaatgcaattgacgcggagaaaacaaaagcgcttcaggaagaaaattatgagcttgccgcgaaactgcgtgatgaagaagcagctttggaaaagcagctggcgcatgaaacaccggcctcttcacctgaaatcggcgcggagcatattcaagccatcattgaacaaaaaacaggcattccggtcggaaaactccaggctgatgaacaagtcaaaatgaaggaacttgaagagcatcttcatcagcgtgtcatcggtcaggaaaaagccgtgaaaaaagtggcgaaagcagtcagacgaagccgcgccggtttaaaatccaaaaacagacctgtcggctccttcctctttgtcggaccgaccggagtcggaaaaaccgagttatcaaagacactcgcagatgaactgttcggtacaaaagattccattatccgtctcgatatgagtgaatacatggaaaaacacgccgtatcaaaaattatcggttcaccgccgggatatgtcggacacgatgaagccggtcaattaacggaaaaagtgcgccgcaatccgtacagcatcgtgctgctcgatgagattgaaaaagcccaccctgatgtccagcatatgtttctgcagattatggaggacggccgtctgacagacagccagggcagaacggtcagctttaaagataccgttttgattatgacaagcaacgctggaaccggcgaaaaacaggtgaaagtcggattccaatctgaagagagcgtcatggaagaacaaacgctgattgattcactgagcgcgttcttcaaaccggagtttttaaaccggtttgacagcattattgaattccaatccctgaaaaaagaacatctcgtgaaaatcgtcagcctgcttctcacagagcttgaagacacattaaaagagcgcggcatcagcctgagcgtcaccgatgatgcgaaggaaaaaatcgctgaaatcggctaccaccccgctttcggagcacgcccgctcagaagaaccatccaagaattgatcgaggacgaaatgacagatcttctattggatgacaacgaaatcaaagccttccatgtcgtaatggaagaggacggcatcaaagtccgggcacaataagaaaaaagcggttccctcctcgcggggagctgcttttttgtttctttctccatgccggaagggagaaactgtgaagaattcgggaacaatttttcaatcaccctaaagttccatgcactgccaccgatattaaccatagaaagctagtataaaggatttggtgaaaactatggataaaacatcgattatcggtatcatcctcgcagtgattgctttaagcgtgggcatggtgctgaaaggggtcagcttaagcgcactcgctaacccggcagctattctgattattttgttcggtacgatttctgcggtgatcatcgcattccccggaaaagaaatcaaaaaagtgcctgccctttttaaagtgctgtttaaagaaaacaaacagctgacaattgcgcaactaattcctatgttctctcaatgggcgcaaatcgccagacgtgaaggtctgctcgcattggaagcaagcattgaagacgtggatgacgcatttttaaaaaacggcctgagcatggcggttgacggacaaagcgcagaatttatcagagatattatgactgaagaagttgaagcgatggaagacagacaccaggccggcgcagccatctttacacaagccggcacatatgcgccgacactcggcgttttgggtgcggtcatcggccttatcgccgctctttccaacatgaacaataccgaggcgctcggacatgccatcagtgcggcgtttgtcgccacccttctcgggattttcacaggatatgtactatggcatcccttcgccaacaaactgaaacgcaaatcaaagcaggaagtcaaactgcgtgaaatcatgatcgaaggcgttctgtcagtgcttgaaggacaggccccgaaagtgatcgaacaaaaacttctcatgtatcttcctgcgaatgaacgcgcaaaagtcgctgaacaagaaggagaggcaaacaatggcgagaaaaaagaagaagaagcatgatgacgagcatgtggatgagtcttggctgatcccgtacgcggatttgctcacccttcttttggctctgttcattgtattgttcgccatgagctcggtcgatgcggcgaaattccaaatgctgtctaaatcatttaacgccgtgtttaccggaggcacgggtgttcttgaatattcaagcgtcacccctcctgaaaacgaaaaagacggcgttgatcagttaaaaaaagacaaggaaaaagataaagaacagaaaaagaaagaaagagaagcagccgaccgcgaagaacttgaaggcgtgcaaaagcaagtcaatcaatttataaaaaacaaaaagcttgaaactcagctggaaacaaagctgactaaagaaggactcttaattaccattaaagacagtatcttttttgattccggacgggcggacatccgtcaggaagatattccgcttgccaaggaaatctcgaatctccttgtgctgaatccgccgaggaatattatcatcagcggacatacggacaatgtgccgattaaaaactcacaatatcaatctaactggcatttaagcgtcatgcgggccgtcaacttcatggctattctcacggaaaacccgaaacttgacgcaaaagtattcagcgccaaaggtttcggagagtataaaccggccgtgtcgaacaaaaccgctgaagggcgcagcaaaaacaggcgcgtcgaggtattgatacagcctagaaacgccgcgactgaccaaaatcagtaatataaaaaaggaagcctttcaaacggcttccttttttatttctgatgaaaatgtttagcgtttaaccccactcttttcagcatttccgtacacatttctatctcttcatcactcagcacactgatcatttctttaatttcttcagcatgatcagggaaaatatcgtccaaaagacggattcccttttcggaaatttgtgcgaaagtcactcttctgtcagtcggcgaggcttttctgatgagaagttcttttttctctaatttgtcaacaacatatgtaatacttccgctcgctaataaaattttgtcgccgatctgctgaagcggctggttgcctttgtggtacagcagctcaagcaccgcaaattccgtcgggttcagaccgtgcttatgaatatgtttattcatatggtcgttaatagatcggtacgcacgtgacagtacaataaataatttcaatgagttttctgttttatccgtcatacattcaatcatccttttacaaaagaaaccgttacagagaaacattaataaacaaaatgaaaaatgtcaacaaaaatgtttccaaaatttctcttctttttgtctggccttaataaaataatttgtttttctatcattttggttattttttcttattaaagaagtataaaaatgatataatacctctattcaagtgtaatgttggagcgatgcagagtgaatacatttaaaggtgcccggggaaagatcaaactttatctcatattggtgatcatcccggcacttattatcagctttttcatttatgaaaaagaaaagcagaaaatagccgataaacacatacaggaagccagtatgatgctcaaccttcaccgcaataagctcaattatttaatcggtgaaacaaaagcccggatgacaacacttgcgatcgctgtcgataagcctgtcaatgaagaaaagatcattgatattctcgatcaggcttttgaggatgaacccagattcagcggtctgtatatgctgaattccaaaggtgatgtcatcgcaagcacgactgatctgaaatcaaaggtgaatttggccgaccgaccgtattttacgaaggcgaaaaagacgaaaaaaacggttatcacaaatgactactccagcagaattacaggccagcgcatcttcacgatctgcgtgccggtgttagacgcaaaacgggaagtcacggattatttagtagccgccattcaagtcgattatttgagaaatatgatcaatatgctgagccctgacgtttatgtcaaggcaaccaatcagaataaagtgatatttgccagcggacgggctgatcaatcagaaggggtgaaaccggtcagcggctatctggatgatattaattggaatatcaatgtttatccgaaaccggttgagctgaacgagctgaccaaaagcgtactgctgccgatgtccagtattgccgtgctgctgaatattctgttcatcctcgtccaatattatctgcttaagcgcaagacccagctggagcgcgctcaaaatgaagcgcagaaattggagctgatcggaacgcttgccgccagcaccgcccatgaaatccgcaacccgcttacagggatcagcggcttcattcagcttttgcagaaaaaatacaaatcggaggaagatcagctgtatttctcaattattgagcaggagattaaacggatcaatcagattgtcagtgagtttttagtgctcggtaaacccactgctgaacggttggaagtgaactcgctgcaggatattcttgatgagattatgccgattatttattctgaagggaatctgtataatgtggaagtgaatgtggagattctcgtcaatcggccgctcaaggtcaactgcacgaaagaccatattaaacaggtgattttaaatgtcgcaaaaaacgcgctggaatccatgcaggaaggcggccggctgtccatctatttagaagcccgcgaccataaagcagtcattaaggtggccgacaacggaatgggcatttctgaagatatgcttgaacacatttttcttccgtttgtaacgtcaaaggaaaaaggcaccggcctcggccttgtcgtatgtaaacgaatcatgctgatgtacggcggttcgattgacattcaaagcgaagtcgataagggcacagaggtcaccattacccttcctgccgcttcacgatgaaaaaaacaccctgggtcggggtgttttttatttaaagaagaatatgtgtaagaggatataccagaggaacggcatcatagccggcagatagtacgaggcgcttcgtgagccgtgccagcggaaaaatctgctgactgtacgcggtcatctttcggatgcggcgcttgatcaggaagcgcattcagtcttcgttatctgttttatcatcaatcatttgtttgcttcatatgcaggcatgacgtcaccgcgggagaacaagcctattttcttcacaaggccctgtattccttggtgatgtgtgcgatcacggtttaccagctgctgatacgcgttcatcagacagtccagttcctggctgtgcctgatcgtgtcatatccggtaaacccttgtctgttagccgcatctatcatcatttttctttttttatcaatagatacaagcaatttttcttgttcagaataactgcccattcacttcacccctcaccgctaaaagaataggaaacaagtttgattgggttattgagcattattacagattatactttatttgtaaacatttttttactaaataacttattttttcatttcatattggaatctttagcatgaatacgagaataatacccattcaggtaatgatataaacagaatgcggcatattcaagatttaaaaaacagccacagctgactttatattacaataaaaaacctctcataccggcgggggcatgagaggttcgggcgtctatcagttttgcacactttcattttcgtaaatcggcacccagccctcagtcgtcacgaaaattcggattgcgacgacccggcggtcttcctgaagcgtaaagtagtggcggatgttctccggaactgaaatcaaatcgcccggatttaaacggacgtcgaaaaatgtgccgtctttgccttgaatgacgaagatgccgtgtccgctgacgataaagcggacttcatcatccgtgtggtgatgttctctttggaaattttttaataattcatcaagattcggcgtggtatctgataaagaaatgacatcctgagactgatatccgcgccgggctgaaatgtcctgaatctccgtgtcaaacgccgcgagaatccgttctttttcatcttctgtcagattgtatttctccgaaagctcagacggaagtttttcaatgttccactgctcatagatcacctcttgttcgtctaaaaagcgcgctacttcttcctgattttcaatgagcgtattcttttcgtcatgtattctgatggtcgccattttccgttcctccttttattttacaagctgcggccgcagtgacagaagcttgaggtggcagctgaataaaaattcataggcttccagcacccttttcgcttcaaatgcggtccgcccccatgccgtaatgccgtgattacggattaacaccgcgcctgagccggcgtccgcatggtgcgcgaagttttcggccaatgccgggatgtgcgccgggttgtcaatgatcggaacggtcacggacgcgttttcctcccataatccgagcgccttaatcatctcctgcccctgaaacgtgatttgtttttcatccccgtaaagctctgagatgacattattattaacggtatggacatgcagacagcagccggcttctgtcttttggtataagtaagtatggagaagcgtttccgctgaaggttttaaagaatggccggtctcagcgggcttcccgttctcatcgattaagagaaaatcttcgtctgtttcttttcgtttgtcttttccgctcgccgtaacgaggaaagtcagcggcgcgtcggatactttgatggaaagattcccgctcgttgccgggaaccagtctctttcggccagctcgcgctttacctcggcaagttcgcgccagcgttcttcttttacagccacgcctgcacctccccgatgttttcaatgcctgttttcacctcatgaaaatcttgaaaaggcagatgccggaggccgagttctttgcattcagtcaaaagataatctctcgcaaaacacatatcggataactttgcagcctcaacatccgtgaccgaatcaccgatcataatgagaaatttctgctgatcggacagcttccggatgactgacggtttgcagcagccgcattgattggtgcagcctccgtcacaggcgtgcggccagtctatatgaatatattcattgtcaaaggatgcatgattgcagaaaatccgctccttttctacgatcccttccaaaagcggatgcacaaaaaagtccattcctccgcttacgatataaaacgggaggccgtttgaccggacaaacgagacaaaatccaaaaagccgtcccgtattttcgcatccttcagaataaagtctgtcagttcttcttttaagctgctcggcagcagtccgaacatccggccgactccttcttggattgataggcttttagacagaacaccgtcttttaattcaatccactcagggggcgcgaattctttcatcatgctgacaatgttgtcgttcatggtgaccgttccgtcgaaatcacaaataatcagcggtgtgcgggtcatacggcttccacccttccccatttgtctaatgcgagctgaagatctttgcacgacgcggctttttcttcaatcggctgcgcttcaagcaccgcatcaatgatggcgcggaacgctcttccgccgccctcggctcctttcggatggccgtgaatgcctccgccggcattgatgatgtgatcgatgccgaaatcgcgcatcaacaatggcaccataccgggatgaatgcctgccgacgggacggcaaacgacggatgaaagacatcgtcttttacacattcatcatggattgcaagcgcggactccttcggaagagcaacggatccgtaaggtgacggaaataaactgaaatcagcgccgcaatagcggttcagcttgccgagcaaaagcgcatgcgacaagccgtaaacgggagatgaagtgaacgcgccgctgactgccggatgcgccatgatcggaagcgggatttccctgtcttctgcaaggctctgcatcacatctaaaccgtaagcgaacacattcaataaaagcgcgtccgccccgagttctgccgcgcgcctcgctttatcccgcagttcagcggtccttcccgtaaggtttacggcatacagcgttttatgccccgtctcctcccgggtttccttcaggacttgttttccttcgataatgcgggtttcaaacggagccagttcattttcaaagaaaatttcgtcatctttaatcagatccacgcctccgagcgcctgctgtctgagctgttctttaatgtcggcgagattccgtccgatcacgcctttaaatatgctcatcagaagcggtctttcaaattcgcccagcagtttgcggatgccgtatataccgaatttcggcccgggaagggagcgtttaaacccttcggaaaattcaagatcagtcaattttatttttccgtccaatgacagctttccgaataccgtcgtcaggacggccggaatatctcttgaaaagttcgcctcgggataggcgatagtgatgacggattgtgtttcgttttctgaggttccttctttctcctcaacttttacgacccggcctttatgttttctgagctgttcctgcttcaccaggggcaggtcagtccaggagcctaccgtcagccccgccgcaatctgttccgcccgcttttcactgtccgttgtgtctgtcagaagatatgttgccaatacttcgctcatgcgtgaacgcctctctttctttcacaaaacataaaaaaacctcttccgtatgagcagaaagaggcttcgtgttatgtccgaatcttatctctcagctcctgctgcaagaattagcaccgtgctttatcagtcggttgccgggcttcatcgggctcgtccctctgcctgctcttgataagaataatgattttataaagtattttgaattatcgcattgttatccagatatgtcaatgctttttcgggtgaaaagattcagtttcccgatccgttccgcagcttctttaagtctttcttcacttgtcagaagaccgactcttatatagccttccccccattttccgaacccgtttccggcagcgacggcgacatccgctttctcgagcagcagatctgaaaacgactgtgacgtataaccgtcgggcacagggagccatgcaaaaaaggagccagccggagccgtcacatcccagccgataccgcggcaggcttcaatccatgcattgcgcctcgattcatatctgtcattttgcgctgcgacgcatgcctgatcctctaaaagagcggctgccgccgcctgctgcgccgcgggaaacaggctgacaaacatatgatcctgataaagattgatcgcttcgatgacagaagcgtttccgacggcaaatccgacccgccagcccgccatattatacgttttggacaaggtatagacttcgattcccgtctcctttgcgccttccgtctgcaaaaagctcagcggtttatgcccgtcaaagccgacggctccgtacgcgaaatcgtgaacgacacaaataccgttttgttccgcaaaaccgaccgtctcctcaaaaaacgcctctgtcgccacagcgccggtcggattattcggataattgagatacagcagcttcgcctcgctccgcaccttttcaggaattacgctgtaatcagggagaaaccctctttcttccgtcagcggcatcatttccattttcgctttcgcaagggcgacgcccgaccagtaatcaggatatccgggatcaggcaccagaatggtatctcccgggtttaaaagacattgcggaagctcaacaagtcccgccttgcctccgaacagcacggcgacttccgtgtccggatcaagcgtgaccccgtactccctttcataaaatgcagcggctgcttttttgaagctgtaagcgccccggaatgatgagtatttatgattttccggcctttcgacggcgcgcttcatttcttcaacgatatgctgaggcgtcggctgatcagggtttccctgccctaaattgatgacgtctctgccttctttcagcttttgatttactttttgcaccaatgatgcgaaaaattgttccggcagctgtttgagtacatctgagatttcaaagttcatatttttcaccttctaaaaatgtcttgaaatgatagtccatcatcatatatggttaaataaaaaaagtaaagagaaacttgaggtgttaaaaaatgaaatggaccgtttcctgtttgcaatttgatatttcatacggaaatccttcagaaaattttaaaaaagcggaatctttgattgagcaagaaagccgccatgcggatgtaatcgtgcttcctgagttgtggacgaccggctatgatctcacacggctagaccagctggcggatgaaaacggcaaagtttcggaacaatggcttaaagaaacggcaaaaacatacaacgtacacctcgttgccggatcttttgcggtcaaagaaggcgaaaatgtctataacaccatgtacatcgccgataacagcggacagatcgtgaagcggtatcagaaagcccatctgtttcagctgatggatgaacacctttacttgtcagcgggaaacagcgacggttcctttgagctcgacggtgtcaagtgcgccgggctgatctgctatgatatccgtttccccgaatggatcagaaagcatacgtcccagggcgcgaatgtcctgtttatctctgcggaatggcctctgccccgccttgatcattggcgaagcctgcttatcgccagagcaattgaaaaccaatgttttgtcgcagcctctaactgcacggggtccaatcccgataatgaatttgccggccacagcctgattattgacccgtggggccggattttagccgaaggagaccggacggaaggcgcagtccgggcggaaatcgatgtgtcagaaagcgcggccgtccgcggaaccattccggttttccaagacttgcggcgtgatttatattaattttcaaaaaaatgttgacaagaatatccggcacctgctaatattttcatcaactgattaatccgaattgtgatacaaatcaatatattttctcttatcgagagttgggcgagggaattggccttttgaccccaacagcaaccgaccgtaattccattgtgaaatggggcgcgtacattttgcgccgagacgattgtctcataaggcacggtgctaattccatcagatgttatctgagagataagaggcggactgcactgtttcagcctccttctctttcagagaaggaggctttttttcgggcgtattctccgtcacgatctcttactgccactacataattggagggtaaatccatgtcagcaactaaaacaagtctttatgaacaattaacagaaagctccgccgccgcgttagccgtcaagctcggcttattccaaagcaaaagcactctgacatgccgtgaaatcggcgacggcaatttaaattacgtctttcatgtttacgataaagaaaaccaaaaaggactgattatcaaacaggcgattccttacgcgaaagtcgtcggtgaaagctggccgcttacaattgatcgggcgagaatcgaaagcagcgccctcatccgccagggcgaacacgtgccgcacctcgttccggccgtttactattccgatactgaaatggccgtcacggtaatggaagacctctcacatttgcagatttcaagaaaagggctgctggaagggcagcattatccgaacttatcggttcatatcggtgaatttttagggaaaacgcttttttactcatccgattatgcgcttgatgcgaaagtaaagcagcagctcgcaaagcagtttacaaatcctgagctttgcaatattacagaaaggcttgtgtttacagaaccgtttctcgaccatgagaccaacgattttgaagaggagctgcgcccgtacgcagaaaaagtttggaacaattcccggctgaaagaaggcgctgacgaattgaaagccatctttctgaattccgcggaaacattggttcacggcgatctgcacacgggaagcatcttcgccgatgaacatgaaacaaaggtgattgatcccgagtttgctttcttcggaccgatcgggtttgacatcggccaatttatcgccaatctgctgttaaacgccctcagccgcgacggtgacgacagacagccgttatatgaccatactgccgccgtatgggatacatttgtgaaaacattcagtgaagcatgggagaaagactgcctgccttcccacagacacctgctggaagacacactgaaaaacgcgtttgaggaagcggtcggttttgcgggatgcgaattgatccggcgcacgatcggactcgcccatgtggctgacttagatgaaatcactccgtttgacaaacgaatcgaacggaagaagctggcgcttgagatcggcgcctattatatcgaaaacagaaaagaactgaagcatatcaccgaagttctggaccaatttaagctccgtgtaaaggaatgatgcagcatgaccaatgaatttgccatcccccgttccgtggaatggaaagaaacctacatccgcattttaaatcagcaaaaacttcccgacgtcactgagtatgtggaacttgaaacaaaggaagatgtattcgacgcgattgtcacgctgaaagtaaggggcgccccggccatcggtataaccgcggcattcggactcgcgctctccgccaagtcatttgaagcccgcgacctttcagatttccgacgtcagttcgcggatgtcaaagcgtatttaaacagttcgaggcccactgccgtcaacctcgcgtgggcgcttgacagactgacggattccatcagggatgcaatctcaatcaatgaagcgaaaacaacgctcgttcatgaagctattcaaattcagattgaggatgaagaaacctgccgaatgatcggccaaaatgcgctgcacctttttaaaaaaggcgaccagatcatgaccatctgcaatgcgggctcgattgctacaagccggtacggtacggcgcttgctcccttttacttagcgaaacaaaaagacctcggccttcatatctacgcatgtgaaacaagacccgttctccagggatcccggctgacggcgtgggagctgatgcagggcggaattgatgtcacactcattacggacagcatggccgcccatacaatgaaggaaaaacatatatcagcagtcattgtcggcgctgacagaattgctaaaaacggagatacggccaacaaaatcggaacttacggcctcgctattttggcaaacgcctttcagattccgttttttgtggccgcaccgctttcgacctttgacttgcagattgaaaacggcgatcagattccgattgaagaaagagatccggatgaagtcagacagatctcaggcatacgcaccgctcccgaagatgtgccggtcttcaatccggcctttgacatcacaccgggcagcctgatttcaggcattatcaccgagaaaggaattgtgaccggttcttacacggaagaaattgaacaattattcgcagactgtcagctgagctgaaaaaccgctgatgatgttgcctcgggcaatgtcagcggtttttttgtctgcacaatgtaatcacttcatctttttgggcggctgtaatgagatgcattttaaaaaacagctctgcataaccggctatcttttgcggacggctcattttcatcaggcttcgtcctcctttttcaccagaccaacttttttcacttaataaaatgatatgtcggacgcaaaaaaacggaacgtgccatatgttttatttttctttataggatatttgttcgatgttcagcagcaccgcttttacatccgtcttcgtgcccgcgtatcccgttaaggcgctgtttttgccgattacccgatggcacgggacaaaaatcggcagccggtttcgtttattggcttgtccgatggcgcgcaccgctttcggttttccgatcgcttcggccatatcgccgtagcttcgggattccccgtaaggaatcatcgtcagcgcgttccataccctttcctgaaagggtgtgcctttttgtctcaaaggcagagagaattgctttctttctcctgaaaaataggatgccagctgctgtttcgcctccgacagcaaagcggtttcgcacggctttacgccgggcgcgtctttccgccattcctcaaaatcttccccggtgagaaacaggccggtaataaagccctcttcctctgttacgataacggttccaaacggcgcttttacacttgtaaaacagatcattccccgctccttctttcttcggtattctgccggatcggaagcgtcaaatgaaaaaccgtgcccttcccttcttcactttccacatgaatgcgtccctgatgttcttcgatgattttatagctgaccatcagaccgaggcccgttcccctgtcttttgtcgtgtaaaatggctcgcccagacgttttaatttgtcttcggaaatgcctgttccttcatcttgaaaagaaatcaaaatgtggtcttgatcagaaggctggatggtcacgtagatattgccgccgcccggcatgacttcaatggcgttttttaaaatattgataaacacctgttttaattgattcggttcacagtaaatcggcgggatgtttccggtcaggttcagatgaatctgcacattgacaagattggcctgggcattcaaaagatcagccgtgtctttcagaatctgcgtcacgtctttttcttcatataatatcgcctgaggtttcgctaaaattaaaaattcagtgatgatagactcgatgcgttttaattctgaggtaatgacgttaaagtacagggaatattcgccttcaatgcttccttgaagaagctgaatgaaccctttcagcgctgtcatcgggtttctgatttcgtgggcgatgcccgccgccagctcccctacaacatgaagagtgtcggatttccgcagcctctcttcaagttctttggcctctgtgacatctttaaagatggccagattcatattttgaatgatatttcttttgaaggagaattccagtttgcggctgtcactgctgcttaacaggaaggggatttcattatccattccttctaaatcaatctttctggcgggaacacccgcgttttcaatatcaaataaagaaagaatatccggaacggtgtacgctctcagctcctcatccggcatgccgagtatacggcttgcgagaggattcgcgtcaataatgcggaattggttgtcaaataagaccttgccgtccattgagccgttgaatacttttctgaatttcagctcgctttcccgcaattctttttccatccgcttacgatcgctgacatttcttaaaatggttaaatgctgaccttcaagtatggttcgttttgatgtaaactcaagctctttgtattggccgttcgccatctgaaacagcatttcttcacggatttccccgtatttttcatatttcttcttaatctgcttgtattttttctgcggatcaacgataaacgtacataaattcgtctccagcagcttatccatcggcagttcgaaaatgcggcacgccgattcgtttgctttggcaatctttccgtcatcagaccaaatgacaatcgcgtccatcgcgttttcaaaaatttcgcggaatcgctcttcgcttttaaagagtttcaattccatcaaccgtttctctgttatatctctcataatggacatgtagaacccgctgattaagttggacgtaatcgtaaattcaaacagcttctcttcgccggaccgaagcttgacgggcagttctcctttggcatttccttttctgcggagggtttcccagatttctttcagatgctttttgttttcgccgtcggtaaaatggcggagcgacagatgggacaattcattctggccgatctcaaagcttttgcaaaaagagaggttcgcatcaataaacccgccgtccttatcaaacagcacgatgccgtcgacagccctgtcaaacaaatctttaaacagctgctcgttcatggagaattcgcgctctaatatttttttagaggagatgtccctcatcaccacaaaaaaataatcctccccaattccgtctctggcgaggaattcaatgtatttcgtcgcgccgctgtcaagcttaatcggcacctctttccacagatggcctttttttaaaaactttttcacggccttattcagttcttcctgaggcacggaatataaaaagtccaggacggagcggttaataaggctctctgcctcaatctgcatcatccgggccgcagcctcgttcgcctggacgattttcatttccttacggcatataaaaatggcatcaagcgtgttattcataatcacatgataccggttcaaatcactcttcaggcggtcattttcctctttcatccgcttcagctgctctttcagcgactcgtttgtttgcaaatccagagtttcagccattcagtacactccttcttcaaaaacctatccttcaatatttctacaaaatacctcatcttccttcattcgccctatacatttcagaaaatttcaatgatatgacaagttaaagtctttttctacgatccttacctccccgttacatcatcctaacaatcccttttgtcctccttcaattttttgttttttattttaaaatgaacaccaacaggaaataatcatgcagtggatgatttttgaagagaaggtgatgctatgacaaaatcgcgagacagttactttgacaacgccaagtttatcttgatttttctggtggtgttcggccatatcctccggtcatttattaacggaaatgagtttatgctccatctctacaaattcatttatacttttcatatgccggcctttatcctggtttccggctatttcgcaaaaaactttaagcggaaaggttatgtgaagaagctggctgtgaagctgattattccgtacctgatttttcagggcatttactcggttttttactatttgattcaggatgaaagcatggcaagcgtcaatccgattgatccgcagtggtctctctggtttttagtcagcttattcttttggaatctgctgctttatccctttacgaagctgccgaaaatgtgggcgcttggggcgagctgcgggcttgccgtcatgatcgggtatctcgatttcatcagcagcacgctgagtctttcacggacgtttgtctttcttccgatgtttctcgtcgggttttatttaaagaaacggcactttgatttgcttcgggctaaaagaggcaggcagattgccgcgggcgtactggggattgttttcctcttatgctggtgcattgattttgattactcgtggctgttcggatcggagccttattctacattcggcacagtgtcgctgttgagcggtctgtcgcgcatcggctggtatgttttggcctttgccgccactttcagctttttggcgctcgttccgcaaaagcgttatttctttacgaaatggggtacgagaacgttttacgtgtatctgctgcatggattcattataaaaacgctgcggcagatcgggcttgaagatcacttgtctgattatcagaatttagtcatgctcttaatgttaacggccgctcttacgtccattctctccagcaatgcggtgaaaacggccgcacagccgtttattgagctgcggataaccggcttgcttcaagcggtgaaaggaacaagaaacggtgcttattcgaaataatgcaaaatacctcttaagcgttgccgcttaagaggtattttttattttttgccgtcttcttttttcttcggcttcgtctgttcaagcgtttcaatccattttccggcgttataatcaccgagctcgcttgaaaactcttcttcaagcaatttagggtccatcggctttttatggttttgcatgtctttgctgtggcggttttttttcgtcatattactcgcctccttgtttgccgtgttttgatttgcggtttgcgcctctcagtccgggatcaccgtcatattgtgttttgtatgcatctttgtccatgctctcagtcggtgtattgttgttggtcaaagcttcattctttgctgctttgcgtttcatttgatttcctccttctgtcagcaaatctgttttgaattcattaagcattttttttaagtcgcgcactgtcacgtttttggcctcatcaatgagttcatagccgatctgtccgttcggctcaagcagcacatatttaaaatcttgaatgtctccgaggccttcctgcctgatcctcattgacagctggtcttcggtaaaacgcattttttttaagttttccgggatgatttttccgtttctgacaacggcgacggtttttcctgaaaatagaaactcaaaaaagcttgatttgatttctaaatattccatcagaatcagtaccgcaataaaaatcgccgccgcgaaaatggtttcccataaattatgttcaataaacggctgaataataatcgagccgatcgaaatcatgatgactgtctgggtcaccgacagctggctgatggatttccgtccggcaatccgcaataaaaaggtaccgaccgcgatcataactaccgacttccaaaatacggcaaacaatgacgtcacctctttacaagtagaatctccaaagaaactgtttccactcatccattttacggcaataaaaaaacaccgctttctgaaaagcggtgtcagccgataatcatcctttccttcggataatgataatttgcttcgatttcttttcggccgatcaaataaaggaaagtcaaaatgccgatccggccgataaacatcacaatcatgatcacacattttccgatatcgcttaaatgcggagtaatcccgagcgacaggccggtcgttccgaaagcggaacacacttcaaaaagcagtccgaggagcgtctgatttgtctccgtcacggaaagaatcagcgtcgacccgaacacgagcagaatcgccatcatcgtaacgaccagcgacttcatgacatcagcctgatgaagctcgcgtttaaagaccttgaccgctttattccctctggcaaaatgaaacagagcaagaaggttaagcgcaaacgtcgtcgtacggattccgccgccgaccgagctcggtgatgcgccgataaacatgagggcgcagatgaaaaataatgtcggcgccgacagctggctgatatcaattgtcgcaagcccgccgcttcgcgtagcagttgattgaaagagacataaaaataaaacatcatgccagcttttccccttcataacatggcttgcttcaagcgcgtaaatgcccacggctccgaacaaaacgagcattccgaacgtaacggtcgtaattttcgtaaacagcgtgaatgagtatctgcgctgttttgaaaacaaaaagtcttttacttctacgagcaccggaaaaccgatcgcaccgaaaataatcagaagcatcgtaataaactgcacgaaatagtcatgtctgaacgggacgagtgaatttcccgtaatatcaaagccgccgtttgtcgtggcgctgacgctcgcaaagaatccgtgcaagtacgcctgttcaaacgaatcatagtatgttaaaaaatatgttcctaagatgatgccgcctaaaaactcgattaataaaatcaaaaacagcacttgcttcatcaggttgacgataccggaaaactgcgattgattctgatccaccataatgagcttccgttcccgcagaccgatccgtttgcccataatgagccagacgaatgttccgagcgtcataatgccgattccgccgaattgaagcacgaaagccaaaatgacaatcccggccgtgctgaatgtatcagccgtgttgacgaccgttaaaccggtgacactgactgagctgacagccgtaaacagcgcgtctataaacgaccagctggccccttgtttgtgggcggccggcagacttagcaaaataaatgccaccgtcacagcaagaaaatagtataatgcaatcagctgtgcaggcgacaagatctgtatgaatttcttcagttttaatttcataagatagttccttctgcctctcaaatgtagtacgtaattattctaatgatattgggagaatttttaaaggccttttttgaaagatttttcattaccttatgtaatttgccgatctttaaacaaaaaacctctgaaacgattgtcagaggttttgtttattattttgcttccagcctgcggatgcgctcatcgagatcagggtgtgtggagaacagtgacgaatgctttttgccgttaatttttaacgtctgcaccgccgtctggtcttcttcattcacatgtcctgtataagacttcagcgtacgcagggcgtgaatcattttatccttgccggcaaggtctgcaccgccgcggtcagcgtgaaactctctgtggcgcgagtaggcgaagacgacaagactgccgagaatggaaaagataatctgaaacacgatcatcgcgataaaatgcacgaccggtgcgaggtcttctttgacaaagcggcttgcaacccatgccgcgattcgggaaaggaatacgacgaacgtattgacgattccctgcagcagcgtcatcgtgaccatatcaccgtttgtgatgtgtgcgacttcatgggcaagaaccccttccaccgcagcatcatccatctgctgcaataaacctgaagaaaccgcgacaagcgaacggcgcttagaaggtccggtcgcaaaagcattgacctccggggactgataaatgccgacttcaggcattttcgtcatccctgcggcacgggacaatctgtgcacacggtcaaccaattgctgttcttcatagctgagtgactgtttcttcggatttaacacccggacgcccatcatcgttttggccatccatctggacattccgagagaaataaaagaaccgacaaaaccgacgacaagactgaacacgagcaatgccatcagatcaatgcggccattttgtatatacgagccgacaccggtaacgcttgtaataatcgtaagcacaattccgattgtcgtaatgaccaaaaggttcgttaaaataaacagaaatattcttttcgccataattacctccgtcttttttaagatcaaaagaacttatttaattaaattataaatgatctgtttgaaaatgcaacaatttcgacgtatgatgtaaatgtaattctcagtgatatcagaaagtgaacacgtaatcaatcagaggtgaaccatgaacacgtttaaactgacccgaactgatatggtccggcttctttacgcgttaaaaggccaaggagacgcaactcctctccaaatcttattgcaatcagcggaaatgacattggatgaagcggaaagccgtctgcatatccctgaatttctgacgagattcgaacgaaaaaaagagaaaaaggaatacgggctttcaactaacgagattgtcgagctgggaaatctgtgcgagctgacgtctttaaaatcaaccgccgtccaaaactgggtgaagcgcgatattaaagatttaatcggccaccccttactcggcaaaaaatatacaattgaacaagctgtcatccttctcattgtacgtgatttaaaatcaatttatgacttcgaacatatacgcggcatattaaaaatcgcttttaacacgatcacagacagatcagacgacgtcatcagcccgatcagctactatgaaagctgcgcccaagtgattgattatcttcatcataaagcaaacccgccgatgaaggaaacgagcctgcaggagctcgtcgaagagcagacggacaagctcaaaggctgctttaaagaactcggaagcggacaatggaacgatatcagatccatcatcgccgtcacggtgctctccgttttgactttccatattcaagcctcagcctacaaaatgaccagccatttattataattcataacgcttcttcgccccggtgtctgcgccggggttttttgctgtacaacaattgccagcataatcaataccgttccgtttgaaactaaaatgcgtaaacacatcttgccagagaaaaggagatgaaaaagatggcgagcagaaataaactcttagttccaggggctgagcaggcacttgaccaatttaaatacgaagtggctcaagaattcggcgtgaaccttagctctgatacagcagcacgcgcaaacggctctgtaggcggggaaatgacaaaacgtcttgtacagcaggctcaatcacaattaaacgggaaaaatcaataatgcagcttattcgccgggacttctcggcgaattttgatatttatcggcattctcctttccgtgccggtagccgttcggattcctgcggtctgacgaatcttcatgatgccgataggagtcccaatgttcattgcgatcatgattccgctgattccagtaatgattgtaatacttttgcttaggctctttgtcatttccgttttcctgaggattttgtgttgggggctgctctgtttccccatcttgttccttctgtgtgttttcttctgatccggaagctgcatttttgtcggtttgctgactgccgtcctgactgtccggcttcgcttcttccgtgccgggcgttgtttcattgttttccggcttctctgctgccttttcttcatcaggagctgtcttttcatcagccgccggcttttctgtgtccggctgtttgctttgatcagcgtctgtttcggtatctttttgatctgtttcattgccgtcggtttgcttttcagactgtttttcttctgttttcttttcgtttcttcttatgtagctgcctgttgacatcccttcctgttttgctttttctcttgtttccatatcagattcaagagattggacctggtaggtgcccttatatttttcagtcatgtcagccagctgttttttaacgccttttttatatgtattgtcatctgtattttcataaaccgtggaaattaaaatctcttttgattcctttacatatccatgcttgctgcaatcggtaataatattattgatgacttccttaaaatcgctgcttttccaatctccgatgtcactgatgacctgtttggcgtcatggttcagcggtgtcagttcaatgacttcatatttgctgtttaaagccatttcaatgctgggattaatgtcaagcgtcatatacgcgtaagctttgttatcagaaaaaaccgggagcaaaattaaaataaacaaaataatagcagtcatcgtaaacactcccaatttaaaagggcgcagtttcagaaaatcaaaaaagctggcccttcttcccatacgcgtttcgccttcgaacgtaatttcctctccgatttcacaagtgcggtgatcattttttgtttttaaaaattgtccgtcaggggttagcaacgtgacgaattttttatttttctctactatgatccctcttctcatgagtgcaacacccctttaagataatcttttaaataaatataatcaccggtaataataatactcatggcgatgatatattttcggttccgttcaatcgtttttctgctgaccgacacaagctgctccagctgtttgacaggaagctgttttttctggtgcaaaatggacgccagctcttcattttcaacaagcgtgtaggctaccttaatcgcattctgcctcgcatcagtatgcttcggcgattgttccagcagctctttaaaagacaggccgtattctttcagctgcttctgaaaaaaaagaatttcttcccggcgctgttcctgttctatctgtttgcggtattcatcaatggaaagctccgcttcgataaggctctgcgaagattcctggtcgtcgccctcctgcacatccatattgatatgctgagcggttcttgcttcttttctgatatagtctatcacttttctttttataatcagctctgcaaatgcaagcagcgaattacctttttcagccgaatacttttcaatagcttcgttaaacgcgatcagcccgatgctgaattcgtcgtctttttcatctatatatcgtttacaaacggatgaaaccgtcttcgcgataaaaggcttatattgctgtattaaatcgttctgcagatctttgtcgcctttttgtattttttcaacagatgtttcaagcgtttgcttcttttttcccaatttaaacaaaaggctaagcactggtttcacctcagttcctccctataactactcataatcatagctaatttagtagggattcgcaaaggaagaaaaagagaaatcgatttcatttgtctcaattatgacaagccaataagacgtactatacatgatttcgtgcccccatgcagaattaagggggttttctctgtgttttttgtaacaatgctgttataaaattgttatcatatgtcttaaatgtaagcgcttcaaacaaaaaagggaacctgctttctaaaaagccagactccctttttgatcattttacgcgtgttctcttttttccgatgccgcgccggactctgtttgttttgctcctgacataaaccatccgcaaaccgcaatggcagccagaaccgcccagaaaatgattttccaggccgccgaatggatgacatctgccggaattataccgagttcctcatgggccaacgtataaagagcgagcttcacgcctacccatccgacaatcacaaatgccgccgtttcaaggcccggcctggttttcagtaaggatacgaacattgatgccgcaaaacgcataatgattaaaccgattacgccgccggctaaaataacgagaaactgaccgccgtccaagccgccgatggcaggaagccgtgttcccggaagcgttacggcaagtgcgaccgccgctaaaatggagtcaacggcaaaagcgatgtccgcgagctccactttcaagacagtctgccaaaacccgctttctttctgcgttttctgcccggcgttatctttgaatacataccgcttcagcaaatggctgaccgcaatgtaaaacaggtataaagcgccgacggcctggacctgccaaacattcaccagaaatgaaatggcgaacagcgacccgaaacgcaaaataaatgcgcccgccaatccgtaaaataaagccttcttcctttgtttttcaggaagatgcttcaccatcacagccatcaccagcgcgttatccgccgccaaaatcccttccagcccgattaaaacgagaagaacccatccatactccaataataatgcaaagtccaatccattccctccgtttcttttttctatcatccgagcttataccggcggtttttttacgcaaaaaagacctttgccgatataaggcaaaggtcttgctagacatgaatgattggcatgccaacaaagtcgatggatatgatccatgaattgacgactttgtttccggaatatccggacgctactcccctttgggatttcaagaaatatttgtttatacgctcatgataaagcctgtttcatcatttgtcaacgcttaacttttttaacaaattgagaaattttttctgttttgacccgctgttttcttctcttcaaaaacatccaaagaacgagaagcaacacaatgaatataccgagcggcagcatatattgatcgagaatggaaccgacgcttttccaattttccccgagtttcataccgaggtatacgtaagcaaatgtaatcggcagcatcgctgcatatgtatagagagagaacacccagatattcatcttcgcaatgccgcacggcaaagaaatcagcgtcctgacccccggtataaaacggccgctgaacgctaccaaacctccgtgcttctgaaagaaatcatctgatttctgcagaaattcgggttttatccatatgtactttccatatttcagcaaaaacggccgaccgcccagcctgccgatcccatataagacaagcggacctgaaacaccgccgagcgaaccggcaaacacggctccggcaagcgtcatatccccttttgagacccaatagcccgcaagcggaagaacaatttccgccgggatgaattctatactgagcgccaaaaaaattccggcgtaagataagcttttaaacgcttcaattattgatatgatgaaatcttcgatgatctatcactcccggcttacgtctatattctgaaacttaagaatgattttaacacaaaaccttgaggctgaaatatcttttagacatgcccgttataaatatagtcgtttcagatcggtatagcgggagggaatgacatgcgcaatacaacgtcccgcctgtctcctgaatgctcgtctggcggcggttacatcacttaagatctccggaaagttaccatttgcggtaagcggcgctgaccggaattcagttcatatgggcagtgcgttttgccgggatctttgccatcgccgaatctgtttttatgggagcgggaaattctctcggtcactacatggaaatgcgtgggcatttcccggggaatgattctgtataatttttttgatcaaccattgatgattttcggggacttcagcgatttaaagaacttaccgattcacatgcgatttccttttcagccggctattaccgcatgaggaaatagaatagccgctccatgaacgccgcatcacccataagttgctacacatggaacggacccgtttatccacaataaagacaaaaaggagtttttattcatgcacacgatgtggaagggttcgatcagtttcggcctcgtcaatatcccggtcaagctctttgcggccactgaagataaagatataaaattccgcagtcttcataaagaagaccatgcgccgattaaatacgaaaaaatctgcaccggatgtgaaaagagtctggagcctgatgaaatcgtgaaaggctatgagtatgtaaaagggaaatacgtcattatgacagacgaagacttgaaagacgtaaaacaggaacatgaagaaaaagcggttgagattgttgactttgtccagctgcaggaaatcgatccgatttattttaaccggtcatattatgtcgggccgggagacaacggcacaaaagcctatacacttctgcgggaagcgctgaggacgacgggtaaaatcgggattgcctccattacgatccgctctaaacagcagcttgcgattcttcgcgtgtatgacaactgcatcgtgatggaatccattcattatccggatgaggtcagaaatgccggacatgtgccgggcgttcctgagcagacagccgttaatgaaaaagagctgcagacggcgatcacattaattaatgagctgacaaccgagtttgacccggaacaatacgaagacacatgccggaaagcccttctcgccaaaattaacgataagctcgaacatgaagaagcgggcgtgacacctgctcctgccggcccgcgagaagatgtcattgatcttgtcagcgcgcttcaggcaagcattgaccggacgaagcggccgaatcgcgaacaggctgcaccggcacggacaaaagacacagcgtcagctggcggcggaggcaaaaagcagaagacgaccagacaaaaagccggaacgtcttaatcatggtgctgacgatgcagccgattttgacctctgtaccgcctgaaggcagtgagtggcgctatgaggtaaaatatgacggattccgctgtcttctccgcatagacgaaaacggtgttacattaaccagcagaaacggacagacgctgacgaatcaatttccggaaatcacggcttttgcggcccggtgttttcagcacatgaaagacaggttccccattacgcttgacggagagcttgtctatttaatcaatccgtacagagcggactttgagcatcttcaaatccgcggacgtttaaaacgaaccgaagcaattaaaagcaccgctgatagacggccgtgccgctttctggcatttgatctcctcgttctggaaggcgcgggcaccgtctcattaccgtatgtgaaacggaagcgcgccctttccaatctgcttaaagaagcaaatcttcccgcctgccctcatcacttagcggaagaagcgattcaatacattccggagcacactgactttgacgcgctttgggacaaggtcgtccgccatgacggagaaggtatcgtagccaaaaggacttccagcggatgggcggaaaataaacgctctcccgactggcagaagtataaacatatgaaaacggctcacgtgctattaaccggattcaatccgaagaacgggtatgtgacggcctctgttttgaaagacggcatcgtcgtcccgatcgcttccgtttcccacggcatgcaggcggaagaaaaaaacgccgtcagaaccattatggagacccacggaaaaaaacaaaaaagcggcgagtatacacttgagccttctatctgcatgaccgtgcagtatttaaccatattgcaggacacgctgcgtgaagtatcttttgtgtcctttcagtttgaaatggattggacggaatgcacgtatcagcagcttatcctccgctctaaaacgctgccgccgaagctgcagttcacaagcctggataagatcgtttttaaaaaacgtgaaaaaacgaaagcagatttccttagttatatggtgaaaatgagcgattttctgatgccctttcttaaagatcgggccgtcacggtgatccgttatccgcacggcgcgcctggcgaatctttctttcaaaaaaacaaaccggactacacgccggactttgtcacaagcgtgtttgacgggagccacgagcacatcgtatgcagcagcgtaccgtcacttctatggctggctaatcagctggcgcttgaatttcacgttccgtttcagacagtgcattctgaaaggcccgcagaaatcgtcattgatcttgatcctccgtcaaggaatgattttcctatggcagtggaggctgcgcatgtgctgaaacagctgtttgactcattcagcatgacgtcattcccgaagctctccggaaataaaggcattcagctttacatcccgctttcaccggaagcattcacctatgaagaaacccgtgcgttcacaatgctcatcgccgattattgcgtcaggacgcgcccggatctttttacgacagagcggtttatcaaaaaccgaaacggcaggctctacctagattatttgcagcatgccgaagggaaaaccattatcgccccctattcgacccggggcaacgaattgggaacggttgcggctcccctttattggagcgaagtcaactcctctttaacacctgatgattatacgatcgatacagtagtgaaccgcgtcaggacagagggagatccgttttatgatttttaccggaatccgcaggacggcccgctttcaatcgtgcttgagcaaatcaagagaaagagctgacgcttttggtcagctcttttcagtctgatacgtgcacatcaatttttctttggaaataaataaatagcaggagtaaggaatgtttttgagggtgagctgttttgcagtaaagtataaaatcggaagatgggccgctttcttaaacagcctgtagcagccgctggacggttttatcacatcaaaaccgagtctcgccgctcctttatgaagcattgtaatgccgacgactcccttaatctcgtctttccgtttatgctggttaatataatccgctaaatgaggcatggattgatataccttctgatatagcataatcccccttctgaccgcgctttcaataggctgcagctctttcaggagtttgacattatgaagatgaatcttaactaacacgtcgttttttttaatcctggttccgtcgctcaggatgacatcttttcctttatatctagtcaaacggacgcggaatacattcgattgccgtttatcaatcagcgtcagccgggtaaagaagaaataaagcggatcaagtaagtaccatatagacagcagacagcttctcacatgttcaccttctttatattcaaagcaccctcatattttggcatgaggcatgacacattatgattggtaaataatgatgcagccctgtatcagcttatgcaaaaaccgcttcaggctctactgtccgaaacagaaaaaaacactcttcatgaagaagagtgtctgtatccgctttcttttaacggaaaagcaaatgctggctgtgaattcctgcttttttcagtaaggctatcagctgttcctgttcctcaggcataagtcctgaaaacgctctcgcaattctcaatgaatgaatcggataaattttatccaaatactcgtttcctttatcagttaaatgggcgtaaacagaccgtttgtccttcgggtcttgttctctgaccaaaaacccgtttctttcaagcttgtcgatgacataggtgacattcccgctgacaagcaaaagacgcgacccgatttgctgaagcttttgcggtcctctcgtatagagcagctccaaaacggcaaattcagtcggattaaaaccgtgttctttactatcgcggatgctgtgttcagacacactcttgaaagcccttgcaaaaactttgtacaaattcatcgaacgcatcacttcttcttcgttaaatgataatctcatcatatctaccccgtatttaagatttttataaaaaaataatgtaaacccttacaattcataagagtcgttctttgttttatattctattcgtgccgtttttcagaattccttcttttttatataaaaaaatacccttatacatcatttaatttgtataagggttccgttctttatagggaatgttccgaaaaaaatacgcgtattcctttctcagctccgtaattgtcatggaattaagtatttctttcgtatagactccgatctgcagaagctttttggaataatggtttctctctttatccaatgcattttgaagcaaacgactcatgacggcctcctttgttttccgttattctatgatcagaataacgcttttatatcaaagatgtataaagccattgtaaaacttctgtagattatgatgtttttcggtaaagaccgttctggacggctctgagcagcggaaaagcgtgttccccggcaagctgcatgaacgcctccagcatttcatcgcgtttcatatctaattcaatgatttcttttgccagcgaaaccgctttttctttctccattcctatccttcctcctcattgtatctgtacaataagcataaaacgggggcacagaaccatgcattaaccttgtcaatttttctgccgctttttttctaaaattttctattccgcgtcagaaaacctgacaagcgtcaggttttttctctttttttcttatataatatgagtaaaagacatccaggggtggaaaaatgacgacagacgaacaatcttacaaagataaaaaagtaatctcgatcggcattgtaagcgaattaaccggattgtcagtcagacagatcagatactatgaagaacggaaattaatctacccgcagcgatcatcacggggaacgagaaagtattccttcgcggacgttgagcggctgatggatattgccaacaagcgggaagacggcgtgcagacggctgagattttaaaagacatgcggaaaaaagaacaggctctcaaaaacgacccgcagctccgcaaaaaaatgctggaaggacagcttaatgctcattttaagtataaaaaccgctgatcaaaaaagtccgcctcctgtgagacggactttttttataaagcatgaagaaatgcagttgcaatgccgaaataaattaataaggacaaaatatcgttcagcgtcgtaatcagcggtcctgacgcaatcgccgggtcaatgttcagtttatgaagaataatagggacgatcgttccggccatcgtaccgataatcaacgttgcaagcagcgatgaaccgacgacaaaaccgagcgttaagtctttctgccagacggttgcgacgatcgtaatcgcgatcgcacagacgatgccgatgtagataccggttcttaattcacggaaaatcagtttaaagatggtttttttattcatttcttctttagccagtcctctgatgacgacggcaagtgactgtgtgcctgtattacccgtcgttcccgcgatcatcggcatgaaaaacgcgagggcgactactttttgcaatgtatcttcaaaataattcagaatgcttccggaaatcaatccgataaacaaaagcagaatgagccacggcaaacggcggtacgccgccacgtatgctttcgtatcaaatgtaatcgccttaccggaggctgcgaatttttcgtaatcttcatcggcttctttaatcacgacgtcaataatatcatcgacagtgacaataccgacaagcacattattttcttccacgatgggaatggctaaaaagtcataccgctggatcagccgggcgacttcttcctggtcttggagcaccccggccgagatgacacgcgtaaacatgagatcctgcactttatcgtcaggctcgccgagaattaaatctctgtaagagagcactccgacaagctgcttgctgtcattaatcacgtacaaataatttattgattctgcgatttctgcaaagcttttcagcttcacgaccgcatcttttactgtataatgctgcggaatccagacgaagcggttcgtcatcatccggcccgccgattcttgcggatagttcatcaaaagctgtacggcctttgattcctcagcctccatactggataaaagctgttctttcagttcttcatccatctcttcaagcaatgcggcgagatcgtcgttatccattttattcattgcgagagtggctttcgttttaccgaccttatgcaaaacggcaagctgaaattcccgctccagctctccgatcatgtcggtgatgtcatcaaccgtcatatatgacagatagcgggcccggtgcttttccggcatttctttaaataaaaatgccatgtcatagggctgaagctcatctatcatgtttcggaattcttttatttttccgtcccgcaataaaatgataatgcgtaatatgagttcgtcataggtcatgttttggaccatcgggactcgtacctcctttacggagacgcgccgtccgtcaagggaagtgcggcggtttgtctcctcatcatgtcgtcactggttatctggctgtatatgggtacttcttctgacatactcgaatggggagaatccatactccgcacctccttatcatgctcagtcgtgtacgttttgaggcataaaaaaaaccttccgatatgaaggcgaaaacaagcacggcaaataaacgtgcggggcctccaatcgtagagctttagcactgtatggcataggacagccatccagctgcgttaagaatcaccttatgtcgatgattcctgttgacccattggcgtctttggacatttttgggcagcagcgtatctccatacaggagcctcacctaacgaagttcttatttgaattgacacactgagattacagaaaaaaaaggaatgtgtcaaccttaaatttgtgatttcagcacatgcctataaaataaacggaataaaggcataaagcccttattccggcaaatcgctttcatcgtcttctgaaaggaaatgataggattcatgcagcatgagcgcgtattccccttcttttgtcggatgcggtacatactcagcctcgttgatatactgctcttcccttttcttcatatgacagacctccttctcaattttagattgtccaaaagaagctccgttatcataggaaagaaaaaatcacttgcggaacgggacatgcagctatatttttcggatcgtaaaaaagttcctaagcagccacgggcccggtttgaaaccgagcgttaattgccacgcgccgatcgcctgcagtccgaactcccgaacgagaaccattttttcactcatgctccgcacatcctcaaaccacacttcatgcgttcttccattttcatcagtataccggaagtaaggggaacgctcctgctgggaataacggatcattgattgatgcttcatcgccgtttccatggcgcgctgattggagatggcagatccgatcgttccgggacggtacggaatcacccaatcatacccgtacagcggaacaccgagaatcacttttcttctcggcaccctgctgatggcaaaattgatcgtttgcctgacctctgttaaaggcgccacgggtcccggctcactgccggcgtggtgccagtcgtacgccataatgaacatataatcgacgacggctccgattccgccgtaatcatatcccctcagccacggcactgcatcacttgttttcgccggaaccgatatcgttaacgcgagctgatgctctgaaagccgggtttttaactgccggagaaatcctgtgaagagatccctgtcagcttctctgacccgttcaaaatcgatatttacaccgccgtatccctttcttaccgttaaggagacgatattgttgacgagattcgttcttgccgccggattctgcagcacttgatgggctaattccggactgaatcccccttctgtcagattcgtaatgacggcaagcgggcgcactctgttctgccatgtggtttctattgcggttctgtcgtttaaatcgttcatgatatctccattcgggccgaaatgatattcaaacaaagaaatcgccgaagaatacggcgcaaaatcattaatcagctctctatccgcttcaggcgtccgaatgacataaaattgcagggttcccgcaagatagttagagatatcagggatcttcactttcatacccgtccgcagccggttcggcggaatatccgggtttgcctgcatcagctgcatctgcggcacataagccttacctgcgataacggcatacgtatcattcggctgaaccgtatattcattaagagggattaaaagcgcctgccccggaacgatattcgtttcctcaagcccgttgacgcttctgatgctgtcaacagggtatccgtactttctgctgatggaaaataacgagtctccagactgcactgtatgaacaaacatagatgtcctccgtttccttttgatcaaaagggctcttcttatctttatgaatgatcttccggtccgattccaaactctgttcggagaaaggctgtttacaaatcagacatgatcaactatgatgatgtcattataaaaaactgtataggaaacgcactaggggtgctgttatcggctgagataaaacatgcggcaggcgtgttttgatcccttataacccgatctggataataccagcgtggggaagtgcagattgaccggagcgcagggtttttccccatgcgttttcgttctgctgctgcatattccctcggatatgcagttttttatttttcattaaaaaacgggggaggacaccgcaatatgaaacttacgatcaatcgtctttcgtaaaatcaactctttcatacttacgactatcgataagaaagcaggagatcacaatgaaaaattggaaaatgagagaaattgtcgtcatgtccgtcatcagtgttgtatttgctgtcatttatttagtatcaactcatgcaagcaatatagcggcaggatttttcggccggatgagctacgaaccgatttacggtatctggtttatcgtctcggtgattgccgcgtacattattcaaaaaccgggagcggctctcgtttctgaaatcatcgccgcgtttgtggagtgcttactcggaaatccgtcaggaccgatggtgattctgatcgggatcgcacagggaatcggtgcggaagcaatctttttagcgacacgctggcgggtgtataccctgcccgtgcttcttttatccggtatggggtcttctgtgacaagcttcatttatgacttgttcgtttccggatactctgttttgaatccgggtttattagccgtcatgcttctcatccgtctggtctcaggtgcgcttcttgccggccttctcggcaaagcaatcagtgatgcgctggcttacacaggagtgctgaacggcatggcgctcggaaaacaattcaagaagaaaaagaaacaggtgaaccaagatgcaggcatctgaaccccttctatccgccggccgtcttaccttttcttatgatcaggatgaaaagccgatttttcaaaacgtgtcctttcagctccgcaaaggagagcgggctttattgctcgggccgagcggatgcggcaaaagctcgctcgctctctgtttaaacggtctgtacccggaagcatgcgatggggttcaatcgggaaccgtttctttatacggaacacctctttcacacctgacagaacccgccgccagatctatcggcgtcgtgtttcaagatccggaccagcagttttgcatgctgaccgttgaagatgaaatcgccttcggcctggaaaatttgcaatatacaaaagaagatatggacgcaatcatcgatgacgttttagaaaaattagagatcactcatctgaaaacgcgaacgatcgcttcgctgtcaggcggttcaaaacaaaaagtggcgcttgcctgtatcattgcgatggaaccggaactcattattttggacgaaccgacggcacagcttgatccatattcggcacgtgaattagtgcggctgatcaaagatcttcaagcaaaaaaaggcttcggccttctcgttatcgaacatcagcttgatcactgggcgccgtggatggacaggacgattgtccttgacgaaacgggtcagaaggtgatggacggagagacggatgttatctttgaaacaaggattgaagagctgatacagctcggcattccgattccgcgtgtgatctcattgcaggagcacgtcagcattccttttacattgtgtaaagaaaatctgtttcacgaacctgtaccatctctgcccgaaccccggcccgccgcgctttcggcagaagacgcgctgagcgttcacgaactgtcattctcaagaggagcagaagtcatttttcaggatgtgagcttttccgtaaaaaaaggttcaatcaccgcgattgccggtcctaacggaacaggaaaatccacgctcctttctgccgcggccaagctcatccgtccgctgggcggagacatcaaaatagacggcagaccgattgattcctattctgaaaaagagctgcggcgacagatcggatatgttttccagaatcctgaacaccagtttgtcacagattccgtcattcaagagctgatgttcggttttgaaagcaacagagccgcaaaggagaaagctcttcagctgttaacccgattcggcatgagacgccatgcctcacagcatccgttttctttaagccaaggacaaaaacgcaggctcagcgtcgcgacgatgcttatgcacaatgtgaacgttttgatgcttgatgaaccgactttcggacaggatgccaaaacggcgcgggagtgtatgcaaatgctccgtgagattcaaaaggaaggaacggctgttttgatggtgacacacgatatggaactcgtctcggattatgccgacacgatccttgtgctctgcggcacgaagctggtgtaccgcggaacgcccgactcattgttttctgatcatatcggaatcgcggagcgggcgcatttagctttgcccctgcggtatgaatggatgaaacacgacaggaggcggaaaaatgaacttgcggctggaggctgttaacccgtcaataaaggcggcggctgtattgttatgcgtcattatgctgtcatttatttataatccgtacacccctgctttgttttatatcatcattgcgggaggcgtcctctcggcggggcgtgtgccgctgaaaaaatggctgctgttcacgattccgtttgtcattctggccttcggttctttatggacagccgccgtattcggaaacgtcccgacaaccgggagcaatctgctgtttaaactcgggccgattgccgtcaacagtgataacgcggcgctcgggatttctatcgcgtttcgtattttatgtttttccgctttgtcgatgatgtttctttttacaaccgatccgattctgttcatgctcagtctgattcagcagtgtaagctgccgcccaagcttgcatacggcgttatcgcgggattccggtttctccctcttctgaaagatgaaatcctgatcatccggcaggcgcacagaatcaggggtgcggcgtctgattccgggctgaaaggaaagctctccgccttcaggcgcttcaccattccgctattggcaggcgcaatcagaaaggcggaacgcacggccatcgcgatggaatctaaaggctttactgggagccgaaaccgcacgttttacagaactgttactgtgcgccgcgccgactggtgctttttcctgctcgtgcttctgttattcggcgcaagctggctcatttcattgttgtttgtataaaaacaggccgccggagtgattcggcagcctgttttgttatgtatgttattgatgataattgagagcctgagcgagattggacttgaccgtaatctctgagaaattaatgccgagctgtacggcggtttgagcaatttccggcctgattccggataaagtggacgtgacgccgatcaatttcagcgcttcaattaatttaaaaatctgatgcgccaccatcgtatcgacaaccactacacccgacaggtcaattaacagatgttcaatcagccgttttgcacatgtgctcagcgtattttcaagaatgaatttggcgcgctccgtgtcaatatcgccgacaagcggcagcagcgccgtccgtttgctcagcgtgataaccggcgagcttaactccaaaatcatttctctttgcgcattcagctgcatttttgagttatgctcagcatgatcgacaaacgtgtaaatcgtaaaatcaaatacttgtgcaattaaattctcccatttcttcctttctccctcggcaaacgaagattcatgtttatcggcaaacgcatcataataactgatgtatagtctccggtttctcatgaattcacggaccacatactggacgggagtatccagatgcttctggtctttcgcaagctcaatcacccaccgctcgaattcttctaaaaattctttttccggcatgatatacattttattaatatgccggtaaaattctttatcctgctccgtcagttcttctgtgatgacgggatttgtcaaagaataaatcgaattcggatccgaatcttccatcgtttcgatccactctttcgcaatttgatccacttgttctgaaaaatagctgtataacgcttcatttatcttcatctctcttctcctttcccatttccaattatagcgtcagcgggtcatgaatgaaaatgaaagctgtcaaactatccatttatttgaaattttttagtccgatagattacgccttttttatgaaaatgcttcaaatgactctttccggccggcatgctctgccataaaatagtagcaacacccttgtatccactggcaagcataaaaaaggagggcttttttatgaatggtgaaatgcatttgattccttatgtcacggatgaacagatcatggatgtgaacgagcttcctgaggggattaaagtgattaaggcgccagagttgtgggcaaaagggtttaaaggcaaggatattaaaatcgcggtccttgacacaggctgcgacatcaatcatcctgatttgaaagaccggattgtcggcgggaaaaacttcaccgatgatgacggaggcaaagaagacgtgatttccgattacaacggacacgggacacacgtttccggaacgattgcagccaatgattcaaacggcggaatttcgggtgtcgcgccggaagcaagccttttaatcgttaaagttctcggcgggaaaaacggcagcggcaaatacgaatggatcattaacggcatcaactacgccgttgaacaaaaggcggacattatttccatgtcactcggcgggccaagcgatgtgcctgaactgaaagaagcggtcacaaatgcggtaaaaagcggtgttctggtcgtttgcgcggcaggaaacgaaggcgacggagacgagcgtacagaggaactgtcgtatccggccgcttacaacgaagtgatcgcagtcggatcagtctcaatcgcccgtaaatcgtctgaattttcaaacgctaataaagagattgacctggtggctccgggagaaaatattctctccacccttcccaaccataaatacgggaagctgacgggcacttcaatggccgccccgcatgtgagcggtgcgcttgccttaataaaagggcttgaacaggacgcgtttcagcggacgctttctgaggctgaagtctacgcccagctcgtgcggcggacccttcctttggacatcgccaaaacattggccgggaacggatttctgtatttagacgcgcctgaagtgctgatggaaagagccgaacaggcacagctgctgtctttctgatatttttctcgtataatgattgatcagtttgtcacatcaccaatttttaaattgtgagattttctattgacagtgatctgaataagctgataagataaccaacaaatgatgtaacttttcaaaaaaattgaaatactttctcttatcgagagttgggcgagggattggccttttgaccccaacagcaaccgaccgtaattccattgtgaaatggggcgcgtgatttttgcgccgagacgattgtctcataaggcacggtgctaattccatcagacgtgatctgagagataagagaggcttgcattttgaagttaaagcctctttctctcatgagaaagaggcttttttgttacatctcacttaaaggaggagacttaatgacaacaatcaaaacttcgaacctcggttttccgagaatcggcttgaacagagaatggaaaaaagcacttgaggcttattggaaaggaaacactgataaagaaacgtttcttaaagagcttgacggtttattcttatcagctgtcaaaacacagcttgaccaacatatcgatatcgtgccggtctctgatttcactcattatgatcatgtgcttgataccgccgtcagctttaactggattccggaaagattccgcagcatcacggatcccgttgatacatactttgcgattgcccgcggtgtaaaagacgccgtttccagtgaaatgacgaaatggttcaataccaactaccattacatcgttcctgaatatgacgaaagcattgaattccgtctgacgagaaacaaacagcttgacgactaccgccggatcaaagaagaattcggagcggaaacgaaacctgtcatcgtcggtccgtatacattcgtcacgcttgcgaaaggatacgaagaatcagaagcgaaagcgattcaaaaacgccttgttcctctttatgtgcagctgctgaaagagcttgaagcagaaggcgtcaaatgggttcagattgatgagcctgcccttgtgacagcttcttctgaagatgtccgcgccgcaaaagacctctatgaatctattacaaaagagctttcaggactgaatgtcctcctgcagacatactttgattcagttgatgcatatgaagaactcgtttcttatcccgtacagggaatcggacttgatttcgtgcatgataaaggcagaaaccttgagcaattgaaaaagcacggcttcccgaaagataaagtgctggcagccggtgtggtcgacggccggaacatttggaaaatcgatgtagaagaacgccttgatgcggctttggatatcctcagccacgctgatgttgaggagttatggattcagccttcaagcagccttctgcacgtgccggtggcgaaacaccctgacgagcatcttgaaaaggatttgctgaacggcctgtcatacgctaaagaaaaactggcggaactcggcgtcttaaaagaagggcttctgtccggcaaagcggccgtcagtgagcagatcgaagaatcaaaatcggcacttaaggctttaaaagcattcgcaacaggagcgaactccgctcaaaaagaagagctgaatcagctgacggaaaaagatttctcccgtccggcaagctttgaagaacgattggcgctgcagaatgaatcactcggtcttccccttctgccgacgacgacaatcggaagcttccctcaatctgccgaggtgcggagcgcacggcaaaaatggcggaaaaaagattggacggatgaacagtaccaagcctttattaatgcggaaacgaagcgctgggttgacattcaggaagaaatcggcttagacgtgctcgttcacggagaatttgagcggacggacatggtggaatacttcggtgaaaagctggccggattcgcctttacgaaatatgcatgggtccagtcttacggttcacgctgcgtacgtccgcctgtcattttcggagatgtcgaatttatcgaaccgatgacggtaaaagatacggtctacgcccaatcgctgacggaaaaacatatgaaaggcatgctgacgggacctgtcaccatcttaaactggtcattcccgcgtgtggatatttcaagaaaagaaatcgccttccagatcgggcttgccctcagaaaagaagtaaaagcgcttgaagatgccggtattcagattatccaagtggatgaacccgcgctccgcgaaggactgccgttaaaaacgcaggattgggatgaatatttaacttgggccgcagaagcattccggttaacgacgtcttctgtgcaaaatgagacgcagattcatacgcatatgtgttacagcaactttgaagatatcgtagatacgatcaatgatcttgacgcggatgtcattacaatcgaacacagcagaagccacggaggatttttagagtacctgaaagaacatccttacgtgaaaggcctcggactcggtgtatacgacattcacagcccgcgtgtgccggcaactgaagaaatctatcaaattattgatgacgcgcttgaggtgtgtccgactgaccgcttctgggtaaacccggactgcggactgaaaacaagacagcaggaagaaaccgttgcggcattaaaaaatatggtcgacgccgcgaaacaggcacgaaaaaaacaagctcagcttgtataatgaaaacagccatccgtaaattgcgggtggctgttttttctgggcatgctacttattctgcagcgcttctgccagttcatacaatgaatcatactgcttaatttgatagccccgcccctctttttgcaaataccctttttggcagaattgcgtcagcacatgcaagagatgacggtaagatacacccaaataatcacagaccgttacgtgcttctctttataaacccctttataagccgtctgcaaaataaaatcagcaagccggttttcaagcgggaacgccagactttgtgaatatttcgaagccataagcgttgccttagcacttaaaaacttagccagctcacgcaggaatttcgcatcctgcagcaattgcacgcggcagcggtaaataggcagaacaaaacaaacagtcttcgctgaggcttgaattccttttgtgtaatacacttcatgtaatagttccatctctccgatgtaatcatttttgttgataaaattaattaaagaaactttcccgttttggtgggttacatatattttcgcttttccttcaatcacgtaaaacaggaagtctggcctcctgccctcttgaataatccattcgtcccgctcatattcgcgcacttccataaactcttcagcggggaaagagaataaatgcgcgattgagtgtttttctaactgatgccgctttttctcgcctttataaatttccatcgtccaccccaaaaatatgagatatctcatattgtctttatgtccttacatgataacatgccaattaaaggaggaacgggaatgaaagcatatcgctggatgagtctgcatttttttagtttttttatgacatggggtgtttttctgccctattggacgggatggatggtgcatataaaaggggtttccgtatccgaagccagtttcattatgagtctgggcctggcggcaagagggatttccacattatttttcttcccttatttatcaggaaaattcagcagcaaagccttattaaacggcgccagaatcgggacgcttctcgcacttttatgttatattccggctgattcttttcaaagcctgcttcttgtcacattagtgctgcatgtgttttacccggctttaatgcctgctttagacagcgcttgcggcgtccttgtacagcataacgaattaaaggcttatgggactagccgacagtggggatccgcgggttttgtttcagccggcgtcatcctgtccgtctttacaggtatattcggagatcaagcgattttatgggcactgcttttgggcgccctgatattcgcatccctaagctttatgcatgcgccagctgttctttcaaaacggccggaaacagaccgtgcaagaaaagagggcatgtttgccttattccgcatcaaatatttcggtctggtgctcgcaatcgttatcttactgcaggcggcacatgcatcttactacaattacggttatctctttttgcaggaaatcgatgcgcccgcatatgccatcggaatcatcatcaacatcgccgttatcacggagattatcttctttgcaatcgctgaccgatactttcatcaatttacggcaggctctttgctcgccctggcggcgcttggtgctaccgtacgctggatactcgtatttgcctttccgcatgtcatcattttctgtcttgcgcagacgctgcatgcctgttcattcgcgatgggacactatgcatttatgaaatacttaattaaaaatatttcacccgcgcaaatcccgaaagcccaaggtatatattcagcgcttgctctcagctggagcactgcggtatttactattttcggaggttttttatatgaaattgaaccccggtatgcctttatcggaatgattgtttgtacgataccgtccatgcttctcgcccttttatacagaaaacttgaaatgaaaaagagcgtttttgcaggaaacgcacaagatatatagccatcgctttatagacgatcacatgtcccgctgtcattttgaccgattttgtgaatgctgtgcgatgtattttctctatatttaaagtatttccttcatatatgatgaaattaatgaagggaattcgttcagaaacttggacagaatcagtgaatataatgatacagtactgcttacgctcatttgggggaactttgttcgcaataaaatgattttcagccaactcataaggagggacattgtgtcacagcctaatatgcccaatatcacccctgtcgttacactttccagagacgataccattaaccttcttctttcgtcaattgctatggaagagctgggaatggcacatattctgaatgcggaaggggaaaaaatccaatacgcgctcggaacgattcccggattaacaggacccccgtcaagtcttgcggatattcttaacctgaatgagagcgtccgggatacgcttgacagcttaatgaaacaggagctccttctcggttcaaaattggacagtatctcaaatatccctacattggcgggaccgacgggggccacggggccgacgggggccacgggtgcgggtcttcaagggattgttgcttttaatccgctgatcgcccctacttacacgaccggacaggttgtcttgtataacggcagctcttatgtcgcaaacgtaaacagcccgtcgggaacccctgaaacctcagctgactatacacttttagctgcggcgggaagcaccggcgctactggttcaaccgggcggaccggaattaccggggctactggcggcactggatcaactggaattaccggcgttacaggaccgaccggagttaccggggctaccggcattacagggcctccgggaagcaccggaacaagtctgacagccacttccggctatgcgagcaatacgggcggcggtgttgtcgcagttattaacggcggcacggccatttccttaccgaatgaacaaaacctctcagcggatattaccgctaatgccgcaaatactgtattcaccgttgctccggcaggacggtactatatttcctaccatattaatttaacggccggcctgctagtaagttcgcgcatcttaatcaacggcactccggctgcaagttcgattattgctccggtcgcgtctttggcaaacttcaataactcctttattgtgactttgacagcaggcagcaccattcagctccagctgttcggattattgggtgcggccacattgcttagaggaagtgccggcgcagctttaaacattattcgattatcttaatggaacatgcaaaaaaaggatcaggcgtttgtccgctgatccttttttaattgagacagaagttcttgcgcgggtttaaattgcggattgaatttcacggattttttggcgtaagcgatggccgtcatatcatggtttaatgcagcatggcatttcgccatataataaaaagctctgaaatcggcggcaccttttaaaatgaagtgatcagcgttttctccttcaacctgcgttccggcttcaaatgctttgattgccgctctgtacttttccaaatgatataatacaaggcctttataataatgaagattgctgtaatcaggataaagcttgagcactttttcaatcccttgttcggcttcttcatatcgcttgagctcaagcaatattgtatattttagaaaatacagaagagacggaggcattcgtttctcacttaaaaattgaaatattgagccgttgacaagatgtaatgctttttcatagtcttttattctgtaacattcacttgccagatgatagactagccacggatcaggattttcctctgaaagttcttcatttaatatgctgatattccgtttatgtttttgtttgattttttcttcctgctccaagtagccgtagtgatgaatcacacatgggagcgtgaaaaaagcattgttttcttcctcattgggagccgagatattctcgtgaattctgccttgatacagaaggcctttatgattgcggaacagcctcggctgcatgctttcaaacgcttcgttttcatcgagctgcttccccgtataattgatgattttcaaaagtccccggctcggtaatccgtcatgaagcagagaagttaaaaaacggcccgtctcctgatcgagctcttcatccgcgtcaagcactaaaatccaatccccttcggcatgctgcagggcgtaatttctggcctttgcgaaatcattctcccattcgaaatcaaacactcttgcctgaaagcttttacatatatcttttgtattatcttgtgatccggtgtctgcgatgacgatctcatcagcgatgtcttgtacacttgataaacaacgggagatatatctctcctcgtttttcacaatcatgcaaagagtcagtttacattcagcatttccgctcattttctcacctttcccgattttggagttgttgattgaaccaaggccgtccaggagtgccgttcatcgttatgatgacaggccgcacccatctgacggcaggttcggcagttgattctgcatcccattcctgaagctgcctgacagcccgcttcgtaatgggatgcgcccggaattcgcgcgggctttcacaaatgaattttttcgttcgttccgtcactgtcttcatttcatgaaagtgccgcgcatacatctgcttctgttcttcttccaagctgatcattaaaaacagccggccgcccgtttccatctgccagcggcacaatgcggagaacagcctgatttcttctttgtaatttgaaccccttcttttatccacggtcacagataatatatttaacagcgccatcgtgagacaatgcaaggcttcaaaagatgtctgtttcgcttttgagatgctcggatacggcatatgcttcacccgtctctttttttatgaacgctccccgccttttttcttccaatcgcagtcctcacaatccccgcactcacagcagccaatacggccgtaaaacaggtcgtcacacggatcttccggatcactgggatcgtccggattccacgggtcatcaggatcgcccggatcactcggattacttgggtcgtccggattccacgggtcatcaggatcaccgggatcactcggattacttgggtcgtccggattccacgggtcatcaggatcgcctggatcactcggattacttggatcgtccgggtctatacaggcttcagcatcctgtaagtagataatgtcttcaagcttcgtctgcaaaaggagttgtgatttcatgacggtgcgcaggagccgttcagtgcttctattgattgatgataattcccctaaggagggatcgccggaagcgctgagaaacatttgaatcctttccgcttccgcctgcagaatatgggatagtccgatttcttccatagccacggatgaaagaaggaggttcagggtctcacatctggagagtgtaatgtcgggggtgatgttcggtatgtttggaagagtcatcgatttctccctcttttctcttggtgtcattatgcaaaagtgctatatcgtattcttattccgggagagaagagatcattactgatgttttcgttaataaaatatcccggatatgaaatccgggatattcgttcgtttctttatttcaattcaagtttgacgtctacatttcctcttgttgcttttgaatacggacagaactcgtgagcggcgtgcaccagcttctccgccgtttctttatcaagatcttttgtatcaatgacgagcgttacgccgattttgtaacccccgtcactctcatcttttaaaaggctgacctgtccttcaatttcagaggtcatgtcgattttttgtttttgggcggcgagttcaagcgctcccccgaagcaggcagcatatcctgccgcaaagagctgttcagggtttgtgccggtttctccgtctttttttgcattcggcatgatgatgtcaaaatccagcaccccgtcttcggatttaatatgtcctgctcgtccgccgactgcggtcgcttttgaagtaaataatgccattattatcagcctcctcattgtacttactgtatatattgcccctgctcatatttttaaacatgattgcaataggaaatgggccgtttttcggctacaataggggtaacgttaacaaaaaagagttggtgaaagaatggcagaaaaagattttgaacatatgaaactggagaatcagctttgttttttgctgtacgcaagctcaagggaaatgacgaaacggtacaaaccgctgcttgataagctcaacgtaacttatccccagtatttggcgctgcttttattatgggagcacgaagaactgaatgtgaaacggatgggtgagcttttgcacctggattccggaacgctgacaccgatgctgaaacggatggagcagcacggaatcatcatgagaaagcggtcggctgaagacgagcgatccgtgacgatcaggctcacagatgaaggacgggccttgcagaatacagcggcagatatccccattgccatgctggaacagacgggactgtcaaaagaggaattaaagcaggtaaaacagtcgctttatgaggttttgaaaacgctgcacggcaaaaaataaggatgccccgaatgggcatccttatttttattctgctgccagaagcttcacttcaatatttcccgctgtcgcttttgaatacgggcacacaccgtgcgctttttggataagggcttcaagctcctgtttctcaatgccggatgctttgacctcaagggtaacgccgagtttatatccttggtcgctttcatctttcagcagactgacatgcgcagtgacctctgtttcaatactcagacgctcttttcttgctacgagttgaagagcgctgtcaaagcaggctgaatatcctgcggcaaacagctgttcagggtttgtggcttgttcgagcttttttgctcttggcgttcccggcatggcaacatcaagattcagcaccccgtcagaagacgtgactttcccttcacgtccgcctgcggctgaaacggttgcagtaaataatggttttgtcatataaattcacctctattatattgtgtacaatttaattttacgaaatataatggaaaccgtcaatctttccgcataaaaaaagcttaccctttttgaaggataagcttaaaagattatacccggatttgtccgtttcctttgatgatgatttttgtagatgttaacgccggaagtcccatcggccctctcgcgtgaagcttttgcgtgctgatgccgatctcggctccgtatccgaattcaaaaccgtccgtaaaccgggttgaagcattatgatacacggcggcggcgtcaacggcggtctggaagtaagccgcatgctcggcgttctccgtcagaatggcttctgaatggtttgtgccgtactgctgaatgtggcggaccgcctcctgtacgtcctgcaccgtttttacactgagaataggcgccaggtactccgctccccaatcggcttcttctgcttgtttcgcttgaggctccagtccgcaaatcacctggtctcctcggagctccacccctttttctgtcagctgattcagcagctttcgtccgtgttcttcggcccatttttcatgaatcagaagagattcaatcgcattgcagaccgaaggacgctgtgttttggcgttgatgacgacctcgcttgccataaggggatctgctgactcatctatgtacacgtggcaattgcccgctccggtttctaaaacgggtacggttgattccctgaccacaagatcaattaaatttttaccgccgcgcgggatcaatacatccagcccatcatttaatgtaaagagctgtttggcggtttctttgcttgtatcttcgatgagctgaacggcatcaatcggaagctttgacagcccaagtgcgcgtttcatcacactgacaagcgctatgttgctgtggatggcggaagaacttcctctgagcacaaccgcgtttccggttttcagacagagtgtggccgcgtctacggtaacgttcggtctggcctcatagatcatgcccactactccgaggggcacgcggatcttttcaattgataatccattctcttttttaatggtctccaatgattcaccgacgggatcttcaagaccgattagcagttccacggcgtccgcgatatcgagcaggcgtttttcatcaagcgtcagcctgtcaataatgtcaggtgtcaatcctctgttccgtcccgcttcaatatctttctgattctctgttaaaatcagctgccgttcatttctgagtccgtctgcaatacattggagcgcttcgtttttttcagccgtcgttttcatgaccatttcggcagccgcttcttttgccaaagccgctttttgcaatacttcactcatttgtgttcccccttgtcaaataaattcacccaatcatctctgtgaatcacttccacctgcttcgttcctgaaagctggtcgctccgcttccctttggcttctaaaatttcatcggatgagtactgtgtctgccctttgccgataatgccgccgggccctctgacttccactacggctcctttcggaaaactgccgcagacatcggcgacgccggccgggaggagacttgacccgttatggatcatcgcctgctccgctcccccatcaatgatgatttcccctgatatcggagaatgaaacatgatccattgccgtgtattattcactgaggacaggtctttatcgccgatataagtgccgtcgccttttccgtttaaaatcaccatcagtttttcacgtccggagccggttccgataaacaccttcaccccgagcgacaatgcggtctgggcggcgagaagttttgacttcatgcctccggtgccgacctttgagcctgctgacccggcatatccgagcaattcaggtgtgatgtcattcagatagtcaaaccgctttgcgtccgggttttcattcggattggcatcgtacagcccgttaatgtctgtgagaatcattaattggtctgcatgaatcaaaccgcttacaagcgccgacagcatgtcgttatcaccgaacgtcagctcttcgactgatgtggaatcattctcattaataatcggcacgacgccgcgctccaacagttccattacagtggcataggcatttctgtaccgctctctttttgagaaatcatttcttgttaataaaatttgtgccggcgtcagaccgtatccttttaaatggtccatatattgctgcattaaaagcgtctggccgactgcggcagctgcctgttttccttttatcgtaacgggtcgcgacggatagccgagagcggaaaaacccgctgccaccgcgcctgaggtaatgaggatcacttcatgcccgttttcttttaataaagaaatggcttccgtatgttccttgatttttgcttcatcaatacttccgttactgttggtgagcgagctgctcccgattttcacaacaattctttgttttttcatcgtttctcctccgtggcaatcaatccaaaccggctctcgtcaataaaaaaagcccattccgtcctgaaaaataaggacgaaatgggctttccgtggtaccaccttgtttgaacgcgtttttcacgcgtcccgctttcctgtaacgccaggtatcgcgcctgagttttcccctcaggactccaaggcaggttcggcaggtttcatgcggcaaaatgtttcagcgggccattttgctctctgtcacagaaagttctgcgtactgatcctcttcaacgctcaatgatttttttatattatgcaaagaaaacaggttcttgtcaagacattttcatccataaaaaacagcccgcctccccggcggaccgtcattaattaaatacgatcgttttgtttccgtgaacgatgacacggtcttccagatgccattttacggctcttgccaacacgctccgctcaatcgttctgccgatattcttcagatcctctgcgtgatctctgtgatcgacgcgttcaatatcctgttcaataatcggcccttcgtcaagatcgtccgtcacatagtgagaggtcgcgccgattaatttcactccgcgctcataagcccgtttatacggattagcgccgataaaggccggcagaaatgaatggtggatgttaataatccgattcggatgggcagatacaaaatcagacgtcaaaatctgcatgtagcgggcaagaacgatcacatcaatcttatactgctccagcagctcaagctggcgccgctcaacttcggcgcggatatctttgttagctttcatgtaatggaatggaatattcagcggctcgaccacttctttcgcctcttcatggttgctgatgacgaccgcaatttcggccatcatattgccgctttgccattcccaaatcagttcatgaaggcagtgcagctctttggatacaaagatcgccactcgcttcagctcacttgccagagagaggctccatgtcatgccgaatgtctgggcgattgaggcgaacgcctgctgtaaatcctcttttttctcacgaatgcccttgcagtcgaattcgatcctgagaaaaaaacgtccgccttcagggtcagtcgtatattgatttgattcaataatatttgcgccgtgttcaaacaaaaacgcggaaacagccgatacaattcccggctgatcggggcagctgacaagcaggcgccctttttcctcattaccgcggcggtattctttcagccgctgtgtcatatatgaattcatctgttttaatccctcgtatcttcataattcgtaacttattatagattatactgaaaatttgataaaaatcaatttacgaaagaattttcagccctacggctgcgcacaaaataagcgcaatgaaaaagatgcgcttcgcatccttctgctcgccgtagaaaagaatgccggctagtgcgccgcccgccgtgccgataccggtccagatcgcataggccgtgcccatcgcaatcgtctccatcgcataagaaagcagggaaaaagaagccgcaaatccgacgataatgaaaaaaatccacttgactttcttttctttttgaaattgattcattaaaatgaccccgagcatttcacaaagacccgcggctatcaggctgatccaatgcattacgccttctcctccttcgtctcaggcttatcctgtgtgaccagctttaatccgatgacaccgatcagcaaaacgccgatcagcacgatttttaccggatcggcctgttctttgaaaagcaggatttcactgagcacggtgcccgctgtcccgagtccggtaaagaccgcatataccgttcctacgggcaggctgtccgtcgccttgattaatagataaaaactgatgatgattcccgtaatcgtgccgccccacgtcagtgccgaatcagcatgtttcaggccggtgacccataccacttcaaatacggccgctatgaccactaaaccccatttcatgttcttcatcctttctgtttccgggcaatacaaaaagcccggaatagtcgtctcacatgagattgactctcccgggcttttttccctccgtgtgcatatgcgggatatgtccgcatatgtgttttctctcggaccaggccatgtatgaacatgcggaaccctagaaaacatgtctgttcgtatcatactacatttcgccgaaacgttcaacgtcagatgtgatgtcaaataccgtcagccgcctctcccatttggtaacggtctcaccgggcaccatgccgattttttccgcgacgcggacggaggcagcattttccggatcaatcagcgccgctatgcgtccgtattgctgcgtatgaaaaccgtagtccagacaggcgttcgccgcctctgtcgcatagccgcagccccagcggcagcgggcaaacatatagccgatttccatcaaagtgtttccgcttatcgtctgcggaacgattccgcattgaccgagaaatgcacccgacactttatcctctgcgatccaaagactgacgccgtatcctgcggccaatcgtttgttccaggcaatccattccttcgtttcccgtctgcttttaagagaaggataatatttcatgacctctctgtcggtaaacagcccgtacaaattgtcttcatcgtcatcccgcatagtccgcagacggatacgcccggttgtcaggatggtgccggaagacttatgtttcatcatgcacgccacgtctcctttccctgtaataaattatggacccggcaggaaaagtcctttttcagcataaaaaaaccgcttttaaaaaaagcggtttgacgattaccaaggtttatctgttccgagcgcctcggccagggccttgctgtgttttaagcggttttttcgttctccggcgcgctgaacggccgtattgtgaagcatgatttcttcctcggtttccggcacgatccgcggaacgggcaccgatttcccgtttgaatcgagcgcgacgaatgtcagaaacgacgttgccgcaagctcgcgttcacccgtcatcagatgttctttaatgactttgacaaacacctccatagacgatgtgccgacccatgtgacgtaggattcaagacatacggaatcctgttggccgatcgggcgcaaaaaatccacagaatccattgaggccgtgactgtttcacaccggcagtggcgggccgcggaaattgaagcgatatcatcaatatagctcatcagctttccgccaaacagcgtattgtgattattcgtatcaagcggaaaaaccctgcttgtcttgacaacccttgtttctttgcaaaatcttgattctggcaacttcatattatttaaactcccctttggtgtctggtcgttttgacatttcatctgtaccctattaaacaatactttgatcgttttgtctaaaattttaaatattaagttggttagatattctatcagaaatgtttcattatttatcacatccgggaataataaacgcacattgaataccgataggaggatatcacatggacgtatccatacccaaatccacgcggaaaccggcttgccgcagtgagtttgatgctttgcagacagtcatcttatgccggccggaacacatgaccatcaaggatattattaacggaacgcagaaacatttcaaacaagaaaatattaacatacccgttgccctcaaacagcatagtgagtttattgacattttaagatctcatcagattgaagtcgtcctgctgcctgccgatcccgctttgcctgagcaggtattcacccgggatatcggatttgtcttaggcgagacagcgtttatttcaaacatggcggcttcagtccggcagggagaagaaaaagtgtttcaagacctgcttgacgataagaaaatcccttatacgcgactgaaaaaagcgaacattgaaggcggcgacatcttgatcgcagacggcaccgtttacgccgggctgagcaagcgtacggataaagcggctgtccgggagctgcgggaggcgctgccggagatgactgttgtgccgatccctctcaaggaggatttcttacatttggactgtgtatttaatatgatctcggaaacggaagcgctatactgtaaaaatggcttgcggcagaaagaaattgatcttctcgccgaacgttttgagatgatagaagtgcctgaagaagagcaattcacgctcggcccgaatatcctgtcaatcggcaatcagacaattatcagcctgccgcagcaccgtcatacgaaccgcgagctcagaaaaaggggttatacggtcattgaaaccgagttttccgaaattatcaaatcaggcggttccttccgctgctgcaccttgccgcttgccagaacatcttaaacatttacaaggcagtttccttcaagatacgttaatatagagaagacaagactctaaagggggaaaccgaatggctaagtacataggatacgcgggaacatatacaaaaggcggaagcgaaggcatttattgttttgaacttgatacagaagcgaaaaggctcagccggccgaagctggcagcaaagctcggcaacccgacatacgtcactccgaattctgataacagcatgctgtattccattgaaaaagcagacggaaaaggcggcgtcgcagcctatcagattcatcagaacagcggggaattaacgtttgtaaaccaccagctgattgaaggcccgtctccatgccacgtcagcattgatgataaacatgaatatgtgttaaccgctaattaccacagcggaaaagtgcacgcctttcccgtcaatgaggacggaagtctgcaggagccggctgccgaagccgctcatacgggaacaggtcctcatgaaagacaagagaaaccgcatacccatttcgctggctatacacctgagcataactacattgcagccgtcgatttagggacggatacgctgtatacgtaccaaatgaaaaacggttcgctcacagaggtgaaaactcactctttcgcaccgggttcagggccgcgccacatcgttttccatccggcggaaaaatacgcctatgtcatgacggaaatcagcaatgaagtcatcgcgcttgaatacaacccgaccttaggtgaattcagagagctgcaggtcatttccgctttgcctgaaggctttacggacaaatcgcaaggcagcgcaatccgcatatctaaagacggcagatttctttatgccgccaaccgcggacatgacagcatcgccatctttaagatcaaccaatattccggtgaattgtctcttattgaatgggtgccgacagaaggcaactggccgcgtgatttcgcgtttgacccttccgagacattccttgtcgcgtcaaacgaagaaacgggaaatctggttttgtttgaacgtgatccggaaacaggcaaattgactctgcttcaatccgacattccggttccgtatccggtctgcgtgtcatttctgcatcagatttaatcaaaaagaaagctgactttatattgtcagctttcttttttgtataaatggcaggcgacaaaacgccccgccttcacttcttcaagctcaggcgttatcttaccgcagagctccatcgcttcagggcaccgcgtcctgaatacacagccgctcggcgggttaagggggctcggcagctcccctttcagaataatccgttcacgcttgtcctcaagaagcggatcaggaatcgggattgaggataaaagcgccttcgtataagggtgaagcggttcccggtaaagcgcagcgctttctgtaatttccatcatgcggcccaaatacatcacgccgatccggtcgctgatatgcttgaccattgataaatcgtgggcgataaataaaaatgtcagccctttctctttctgaagcctttttaataggttgacgacctgagcctgtaccgacacatccagcgcggaaatcggctcatccgccacgataaattcgggatgcagagagagcgctctggcaatcccgattctttgcctctgtccgccgctgaattcgtggggataccggctgccgaaatccggatggagcccgacagcttcaagcagttcatccgccatcatcatacgggcttttcttgtattgtaaagattgtggatttccatcggctccataataatttcccttacggtcagacgcggatttaacgaggcgtaagggtcttggaaaatcatctgcagcttgcggaagaagaccgaccgctgttcggccgcggcacggtgtatatccgtcccttcatatgataccgaaccggccgtcgggtcatacagacggagaataactcttccgagcgtcgatttaccgcatcccgattctccgacaagtccgaatgtttcccctcttttaatgtgaaagctgacaccgtcgactgcttttacggctttctttcttcctgcgtcaaaatgcattttcagcccgctgacttcaaggagcggagatgccgtcattttctattcccccttttcgcttatacagcggcgtacggtgcataattctttttcatagatcgttccttccaaggacagcacttcgattgtttttcccgttttcggggagtgcagcattcggccgtctcccagcgccaaaccgacatggtgaatcgcgccttttccttcttcataggcgaaaaacaaaaggtcagccggccggatatcgtttaccgccgcgccgcacccggcttttgcttggtcctttgcatcacggggaagggtatagccgtttgctttaaatatcgaatacataaacccggaacagtcaaacccgaaaccgctcagtcctccccataagtacggaagcccgagaaacatcatgcccgtttcgatgacctcggccgcccgtccttccgtatgccggcactcgtctgcgtcagcttcatttacgaaccgttctccgagaggcgtcacaacccgaaaaaagcctttctcacgtcctgatgccggaagacgcgttaagaaacttacttccaagtccggttcgccgttagtgtgatataaaaaagctgtcggtttggtaatccatacggcgggcgaagatgaaaaaaagccgtcttttgaaagctggcttttttttatccagcccggatatccgcgcgcatccttgtttgagggctggccgggaacggcgacaaaagcccattccccttcctctttgagaatgatcacctcttccccgaaaagcgcttgcgtttggacaaggttgtctgtgcataattgcagccgctcttcatatcccatagacgctaaccattttctgatctgcggcgggttttcaagcatcggcgcatcatacgaacggggagatgacggcatcgtccatacgttggctgccgccgctgtaacggctgctctcatcttttcgcctcctcttgtttcgacaccccggtaatgccgagacccggttcatcgggaatcgtaatctgactgccgctgtatgtgatgccgcctttaatcaaatcatctttcagcataagcggcgcatcaaaatcaaaccttgtcacattccgtttgcccgcggcaaaatgagccgcggcggtgatgccgagcttggtctcaatcatgctgccgaccatgcattccacgccgcacgtttcggccatcgcattgattgtttccgcctgctttatgccgcccgctttcatcagcttaatattgattaaatcggcgcttctcgtctgcagcacgcaaaaggcctgacggggagtaaagacgctctcatccgccataatcggcgtgtctacggcatcggtgacctgcttcagcccggcgatatcgtctttatgaacaggctgctcgaccagctcaatgccgaggccggcgtcttccatctttcggatcgcagtcacggcttctttcggcgtccagccttggttggcgtccaatctcagtttgacgtttccgccgacacgtgatctgatcgcctgaatccgggcaacatcgtccgatatgtcacctatgccgacttttatctttaaaatatgaaatcctttgttcacatagcggtctgcatcccccgccatctcctcaggagaattgacgctgacggtaaaatctgtttccagtgtattccgatagcctccgagaagccggtaaagcggctgtccgtgcatttgcgcccatccgtcatatacagccatatccaccgcggcttttgcgctttgatttctttccaacagccggctgatatcatacaaaacagcttctatgccggaaaggctccgccccaagagagcgggcttcagcacatcgcggacggcgctttcaataccgtccgtgctgtcgcctgtaatgacaaccgtcggcggcgcctcgccccagccggtcagaccgttgtcaaatgtgagcttcacaatgaccgattcagcattgtaaaccgtgcgcaaagcggtcttaaacggctttttcagcggcacggacatccgtcccgtttgaatatctgtaatcctcacgcctgatcactcccttccggaaacccccgattcaatcgttaccgctttggccgccgtatccataaccgcgcgggctccgatcggaacggcgaagctcggtgaacaatggccgattttaaagcctttgagcgcgggcttccctgatttgacaatgtaatcgttcagcacttgctctaaagtaagcgacttttctttatgcttcggttcgcattggtgaaaatcacagaccagtattccggctgcgtctgacagttttccggccatctttaattgattcagcatcctgtcgatttgatacggctcctcatcaatatcctcgataaacagcaatttgtctttcgtatcaatttcaaacggcgtgccgagtgtggacgtaatgagcgacagattgccgcccgcaagctctccctcggcccttccgcctgtcagcacctccagcggagaaatgtcctccgtataggtgaattccgtttctgtaaaaagctgatgatacgacgcttttgtcaggggttcagcatcttcaagcccgacatccgtgctcagcatcgggccgtgaaatgtgacgagccccgtattttgatgaatggcggtatgtaaaaacgtaatatcgctgtatccccagaaaattttcggattgcggcggattaagccgaaatcgatgtcggcggcaatgcggcccgtgccgaatcctccgcacgcgcatatcaccgctttgacattctgatcactaaacatgtcatggagatcattgaggcgcgcccggtcttctcccgccaaatagccgtgacgggtcttcagcgcccggccgagtttcacttgaaggccaagctcattctctaaaaacagcagcgcggtttgcagcgtcccgctctcaggcgggcttgcgggtgcaatcacaccgaccgtgtcgcctttttgcagtgctttcggtttatggttcatgactttttcaatctcctttccggattgaaaagtgaaacacgccgctcctttaacggcaaaagagcggcatatgtttccgctgtaagatcaggacttttccgcccatttcagatcaatgtaaccgacggggtgccggacaatgcccttcacgccgctgttctgcagatgcacctgattgtaaaagtaaatcggaatgatcggagcctcgttcatgagcagcttttccgctttatgcatgagcgcaaaacgttttttggcatcggcttcctgttttgcctgcttgatgcagccgtcgtatgccgcgcttccccagccggtgcggttcatggaattatccgtttggaaagcctcaagaaaactgatcggatctgcgtaatccggtaaaaatgagctttgagagaactggaacttcagtcctttctgctcttctaaaaagacgttccattccatattggcgagcttaacgtctataccgagcacacttttgagcttctgctgaatcgcttccgctattttcttatgctccggttttgtgctgtatgtcaatgtaacggcgggcagcttgtcataatgctcttctgccatgcctttttccagcagttttttggcttctgattcatccggagttagtaaactgccgcccgcttcgcggaaatctttcccgtcaggctgagtaaatcccggggatacaaaggcatgtgccggcttttcactgtttttggtcacataatccgtgatttctttctgatcaatcgctgccgcgaacgcttttctgatcttttcattttgaaacggctccattttaacgttaaaacgatagaaatagagtccggcctgatcccacgtgcggacattttttcctcccatcagctgctcgctcagctctgccggcacaaaggcggtatccaaatcccccgactggaacatctgatagtcggtattccggtcactgaccatcgcccatgtcactttatccagtttcaccgtctttttatcccaatacgtctcgtttttgaccatcgtcatgctgtcgtcatgcttccattccgtcagtttgaacggcccgttgccgacaaaagtttttgcttcagtgaaccatttcgcatcagccttggcgaccttctcattaatcgggaaatacgccggattggacacgacgctcaaaaaataatcctgcggggccgccaatgtgacgacaagcgtttttttatcctttgccgtgactttcacgtcttcttttttgccttttccgctgttaaattcttctccgcctttgatcatatagccgagaaaagcggaagatgcgcccgttttcggatcgagcatccgcttccaggcgtacacgaagtcttccgccgtgacgggatcgccatttgtccattcggcgttatctcggatattgaaggtatatgtcagcttatcagcggacaccttccagctttccgccatggccggttcgggcttattatcttttccgagcctcgtcaatccttccatgatgttattcagcggctgccaggaaacattattaaatccgatcggcggatcaagtgaggtcggctcattttcgttattgagccgcagcaccgtctctcccccctgttcttttgctttgccgggttctgtccccgcctgttcattggctgtacagcccatcagagcaaacgaaacaacagcaatcacaccaatcgcccatctctttttcatttcaatccccctttttcctctgctgcagtcagctgctgcttcagccgctctgcacggtgatcctgaagccagcagctgacgatacggcttttggatttcacggttgttgccgggtataccttttcacagacgatcatcctgtccgggcagcgggcggcaaacgggcagcccggcggcggatcgaataaatcaggcggcgtcccgtcaatcggcgaaagctcactatcttccatatccagccgcggcactgaacgaagcagcccctttgtgtatggatgagccggacggtaaaaaatatcatgcctcgtgccgatttcggcgattttccccgcatacataacggcgactctgtcggcggtctgagcgacgacgccgagatcgtgggtgatcagaataatagacacgcctgtttttctttgaatcttcttaaataattcaaggatttgtgcttgaattgtcacatcaagagccgttgtcggttcatcggcgatcataatttccggctcgcagatcagagccatcgcgatcacgatccgctgccgcatgcccccgcttaattggtgggggtactgcttcaggcgggatttcgagtccgggataccgaccagatccagcatggcgagaacctcggattcagcttgttttcttgtcatggcgcggtgttccaacagcgcttctgagagctgatcccctatggtcaaagtcggattgagcgccgtcatcgggtcctgaaaaatcatagaaatatcgctcccccggattccccgcatttcccgatccgacattcggcaaaggtctttctgtttaaattgtatgcttccggattcaatctttgccgaatgtttcggaagaagacccatcacggcttgtgacgtcacgctttttccgcatcccgattcaccgacgatcgcaaacgtttcacctttatataaatcgaagctgacgcctcttacggcttttacagtgcctccgtatgttgaaaaagtaacatgcagattttgaacggaaagaacttgctgcgccatttttcctacctcctcagtttcgggtctaacgcgtcctgcaagccgtctccaagcacgttaaacgcgtacatcgttaaggaaatgaaaaaagcgggaaaaaacagccgccaccaatggcctgataaaatcgccggcagcccgtcatttgccatgactccccagcttgcaaacggcgcctgaatgccgagtccgagaaaacttaaaaatgattccgcaaaaatcgccgccggcaccgtcagcgtcatttggacaataatggctcccatcgtattcggcagcagatttttcttaatgatccgaaatgttttcgctccaaacgttttcgatgccaatacgtgttcatcatgcttcatcctcagcacctgccctctcacaatccgcgccatgccgacccatcccgtcactgtcagagcgacgataatggaactgagccccggccccatcagcaccattaacaaaatgacaacgagcagataaggcaaaccgtagagaacctcgatgattctcatcatggcgctgtctgtccggccccctttgtagcccgcgacgcctccgtagataacgccgatcaaaaagtcgatcagcgccgccatcacaccgacaaataaagagatcctcgctccgtaccacgttcttgtaaacacgtcccggccaagttcatcggttccgaaccagtgtgaaaaagaaggcggaagattctgctcggcgagcgtctgccttgtcacgctgtgcggtgatatcagcgggccgaacacagccgatagaaacaggcagcataatatcacaagtccggccatcgccaatttgttctttttaagccgccgccacgcatcctgactgtaagacaggctcggacgcttgaccgactcggtttcaccctttctttccgcgcccggctgaaaccagtcatcaggcacttctgtgtgttttaccgtttcttgcgggagattcatcaggatcaccctttcttatgaagttttatgcgcgggtctaacaggccgtatgccaaatcaaccagaaacagcaggacgatcagaatcacactgtaaaatacggtcgttcccatgatgaccgggtaatcgcgctgattgatgctttctacgaaatatttgcccattcccggtatggcaaaaattttctcgatgacgaaactgcccgttaaaatacttgcggcaagcgtcccgagtactgtcacaacaggcataagtgcgtttttcaatgcgtgtttgatcacaattttgacgggagaaagcccctttgcttttgccgtgcggatgtaatcctgagtcagcacttcggccatgcttgatcttgtcagccgcgcgataatggccatgggaccgacggcaagcgcaacagtcggcagaaccatgtgaacgggactcgtccaggtagctgccggaaaccatttcagatgaaccgcaaattgctgaatcagcagcgtagccattataaaattcggaatggaaatcccgagcaccgcaaggctcatggccgcataatcgagaaagccgccgcgcctgagagcggccgttatgccgagcgcgagtccggaaatcacagcgatgatgatcgccgttatcccaagctcgaaggagacgggaaatccgcgttcaagcatggcgtttacactgtctgacggttttttgattgaaggaccgaaatcaaaggtaagaatggattttagatagatggcgtattgagtgataagaggttcgttcagatggtagtaggattcaagatttcgctggaccgcttcgtttgtgccccgctcttcgttaaaaggcgagccgggtatcactttcatcatgacaaatgtcagagtggtgatgacgaggacggtcataatcatggcgataaaacgtttgataaaataccgcagcaatgccgttcacccctttaacagaatgttgttctcatagcgagttctgtcatgacgagcatggcctgataggcttccggcatgtcttttgcctgaaattgaacgattgtcgttcccgggatgatttctgtgcccggcattaaatgggcccattcagcctgtccgtaattggcaaattcaatgcctaatacaggtttttcaggcggagtcagcggtttgaccttatctttatttttgagcgcataggctgttttttccgtcaggagccgtccggctttttgaggggacaggcatttgaccgcggttcttgaaatggtttgtttgacggcggcagtcgtcacattcgggatcagctcctccgcctcttttgcggcgcaatcatctccggcagccatgatgaccgggacatcgtaaaatccggcgagataggcatttaaccccagttcaccgacaggcttatcatttatgtaaaagtggcggacgccgaatatcatgctgtgcgacatgacgcccggcatcgacgctctcgcatgatagccgataaacatcacacctgaatacgattcatcaagcccctgcatcatggaaaacggcttgacatcccccgtaatcagctctgcctcagggtgaagtttttccgcgagcagattattcatctttgagtggctgtcattcacggtcacttccgtgcatccgttattaaacgcttctgcgatgcaccagtttgcttcttcggtcatcagaaccctgccgcgctcataattgtgcatgctggaattgacaaatgtttcatcaggcagtccggaaatcccttccatatccacagatagatacagtttcatgtaatgcctccttttttatttaaaatttcgatattaaattatgaatattctaacaaattatattaaaaaaggatgaaacatgcaatataccattctgccattatgggaaaaaacaaacccttttcaccgggaaaagggtttgctgatagaaaaagttacataccgtttttgtttatagggtgaccccgaaactgtctgaccgcacttctgtattcgcgatcgggaatgacctgatgcctgatcggtccaggagcctgcggcgaaggcttttcatccgcctgcttacggacggcatgcggtttatgcgccagcttatgtcccatgccggtcgcattcatgacaaatgataaacacactaaaagcaagcttaagatgaaagcaataagaaacaaatcgctgtatgtccccatcagcaggtcatgcggcgattgtgtgccgcgcgcgccccgaagcatgccggaagcatctcttttcgtaaaataccctattaaaacaggtgcgcccatataaatgaacagccttaaaaactgaacggccgtcatgcgtttcaccagttccggaagcggtccgcccaacgcggcgcccatcagtccggctgctacgataagccctgtcccggccgccagcatcacgaaaagcgccgcaaatagaataaacggtatatgatgacccgccgtcatccattggaaattcacgaacaccagtataacagagcctgttatgccgagcatgcccggaccgactttatcatatgctaatgcactgataacagcggcgatggccacgcctcccaaaaggctcgcatataagaatatcagttgagtttgtgacatgtgatatgcggtctgaagctccccgtgaaatgcagaaagactgaccgctatggaaatactgcccgcagcgatcatgaaaacacccaaaatcggctttggaatcagcataagtttaatcgaaatcagcgcatgttcgtttctgtactgcataatcagcaggatcagcagaatgacgatgcttcctccaaatcccgccaatgtctgccatgatgaaaagccccatttcggcagatgaataaaagtataggcggtcagcacggctgatccacccgctaacagaaaaccgatgccgtcaaatggagatttttcagtatttttatgagcgtcatcccgcagccacatataactgaaaatgaggccgaaaaaagacagcaggccaaaaatgccgaacagccaatgccaatggccggcgcttgccgccgccgtgcctaaaacggtccccataatgacggacccgtaaaatccgccgattaacacaaataaggcgtaattccggcgttcaatcggaaacgaaagcaccagcatcggaatcataatcatcagcatagtgcccgccgcagctccctgtaaaaaacggcccgcggcgagcggataaatatcatttgtcacagcagcaagcagcgctccgatgacacccgcggccatcgaaatcatatagacaggccgggagccgaatctttttcttaaatacggccccgccggcacgaataaggcaaatgccatattaccgataataatcggatgaaaagagtcaaagttttccccgccgaccgtctgccggacaaggctttggacagccgaaagagcggtattcgacatcagccccggcccgacagccagcacagcaagcagagaaatgatccagtgatgtttttctttcatttgacagctcctttcttaactatttgacaaagtgaaaaagctaacagatttcccccattagcttgacagaattttttatatcttttcatgtgaaggattgaacataatatcccatttattatttcaaatccgatggaaattgtcaatataaagcgccgccgtccgatttcgtctttttcacaatttcccacaatcttttcattattatcccacactttttgtttaagatggagtcagtaataataggcaaatcatgctatgatgaaatagagaaacggagtgaacatgatggataactatcgtgatgaaaatcggacagaccaaaaagaacaggaagtccttttagtaaaagaaaacccgcagccggccggatattccgagccggacgaggacaagaaaaaacgaagcttcggctggttcagaccgcttctcggcggagtgatcggcggagggctcgccctcggcatctatacatttacgccgcttggagaccatcagactcaagatacttccaatccggctcccgctcaggaaacgtcatcggtaaccgccaagcagacatcttttgaatcagacagcggcaaatcggcaaacagctcatcggcaaattcaagcagcatttcgaatatggtggaagacatttcaccggcgatcgtcggaatcaccaatctgcagaagcagcaaagcagttccgatttattcggattcggatcaagctcggattcaaactctaatgcatcgggtgatgatgcggaaacgggatcgggttcaggcgttatttttaagaaagcaaacggcaaagcgtatatcattacgaataaccacgtggtcgaaggcgcctcttcccttaaagtgtcattatatgacggcaccgatgtaacagctaaactcgtcggccgtgattcgctgacggacttggccgtattagaaatcagtgataaacacgtaacaaaaacggcaagcttcggcagttcatccgctctcagaacgggtgaatccgtcatcgccatcggtgatccgctcggaaaagacctttcccgcaccgtcacacagggcatcgtgagcggcttaaacagaaccgtctcgatctctacgtcagccggtgagtcaagcatcaacgtcatccaaaccgatgccgccatcaatcccggaaacagcggcggaccgctcttgaatacagaaggcaaaatcatcggcatcaacagcatgaaaatcagtgaaaatgatgtagaaggcatcggctttgcgattccgagcaacgatgtaaaaccgattgccgaagagcttctcacgaaaggacaggtggagcgcccttatatcggcgtgagcatgatcgacttggaacaagtgccgcaaaactatcaggaaggcacactcggcctcttcggcaaacagctgaataaaggcgtttatattcgtgaagtggcgcagggatcacctgcagccaaagccggattaaaagcagaagacatcattatcagcttaaaagggaaagaaactgacacgggcagcgaacttcgcaatattctctacaaaaatacgaaagtcggcagcaccgttgacgtgaaaattatcagaaatggcaaggaaatgacgaaaaaaatgaaactgactcaaaaagaagaaacatcttcttaacaaaaatccaaggcagccgccttggattttttatatacagatgaaactttaggcctggatcagccgtatgactcagtgtacaaaggaggatacatacacatgaaacaaaccggacttttgctggtcgttaccggcctgatcttgctgcagctgagcattcagcttcctcagcaaaacgctgcttggggaatgacgcttggtgcaagcattttactgaaatttttcgtgaaccggactgatcatgcgctctctgcacacccagaccggccgcagatgaataaaaaaagccgcgggacattctgtcatcccgcggcttttattttacataaaagcaccctgtccgctggccggacagggtgtttgttaagacatatgctggtcccgataaatcttttcgtttttcataccgtacgctttttgcacgatatagagcggacgatcttttgcttcgtcataaattcttccgatatattcgccgatcattccgagcattaatagaacgatgccgctgaataacagctgtatcacaatcagagaggaccagcccgtaatggtgctgtctgtaaaaagcttcatgtataaaacgataaacatatagagaaaacccgctccggacatgagcattcccgcatagcttgccgccttgagcggtttatgagagaacgttgtgatcccgtccatggaaagcttcagcatttttttaagcgggtatttcgtttcccccgcaagccgctcatctcgttcatattctacagcagtctgcttaaagccgacccagctgacgagtcctctgacaaaaggatttttttcttttaatcttttcatctcatcacagacttttctgtccagcaggcggaaatccccggtgtcgagcggaatatcaatatcagtcacgctccgcagcagccggtaaaacagagaagccgtctgtttcttgaaaaaggtttctccctttcgtttcgttctgacggcgtacaccacatcgtagccttctttccactgctcaatcatatcaaggattaattcaggagggtcctgcaaatcggcgtcaatgacggcgattgcattcccctctgcataatccatacccgctgtgatcgcgatctgatgtccgaagtttctggaaaaatcaataattttcactctcggatcaatcagactttgctctcttaaaatctcaatactgcggtctttgctcccatcattgacaaagatcaattcataatgctcttttgtttgatccatgacttctttcaggcgctgataggttgtctgaatgacgagttcctcgttataaaccgggacgactattgaatattgaatatgtctgctcatgttttttcctcctattcatcagattgaagttcgtatagtgaagctgactgattcattccgcccggcccgccgctcattcggctgtttttacccgcggccttgctgctttttgtatcagctgcatcatgatttttcgttttctgatctgtgcttgattgccatttgtatgaagatactttctttccggttttctcaacccattcaacaatatcgttgtttccgcctttgcccattccggatgttaagaagtattttactttcccttcttttacgagctttttaaattgagtcagcgtaatggccgggtcagacccgctgaatccgccgatcgccatgaccgcttttttcgtttttataatgtaaggcgccgctgtgttggaatcggttgcagcaaatagataatccgctccggcgttatgtttctctaaatagttgatcagttttgtattgacagatgcgttatccattcccatgccttttccgcctgctgacgcaagctgagggcctgtttcaggcaatgagctgttgcctccgtacagaagcggtgtgctcgcccaataaatcggcatcaccatcaagacgagaagggctgcaagtgaaacatagtaactgagcggtttttggcgctgtttgaatacgaacagggcgattgccgccactgcaccgagaacgcctgctccgatgctccagcctgcgccgatttgatcattgtagtttttaaggataaacagctcaaatccggtagtcacaagaatagcggccggcaatagccaagttttccatcccgcctgcttgcggtacagatgaacgagggcgacccatcccgcaccggtaagagcagcaatcggaggcgccagcataatgagataataatggtggaaaaattccgccacactgaagaatccggcaatcggcacaagccacgctgcccaaaagatcgtttccttctgttctgctgataatcttcttctttctctcgccccggcgatcaataaaccggccaatccaaaaatcgcaaacggcaggagccagctgatctgatcagataattcttgttggaagagtctcagcggaccgggtgttcccgtaccgaacattcctgaccctgactgcattttcgagccggtgcctgtaccgctttttcctccgccaggaccgcctttgccgccgtctccgccgcttggagggcctccttgaccgccgcttggcatttgtccgttagatggaggtgccgtcatactgccggtttgtgatttgtctccgcttgctgactggccggccggtttttgcatttgtgaagaaccgccggaagaagacatccctttcgatgcgtttccgtcgggcccgccctggccgccgccggaactttgccccgtcagccgctgaatcccgttatatccgaaagccaattccaatacggagtttgtctggctgcttccgacatatggccttttgccggcaggaatattgtcaacaatgagcggccatgacaatgaaacggctgctaatacggccagcgcgcttaccagtgaaatgatttttttcttaatcgcggtatttgccgccatcatatagaacagcaagaaggccggtaagatcatataagcctgaagcatttttgtgttaaagcctactccgacgacaaaaaatgccgccaaaagccagatcagttttccttttcgaatcgctttaaagagaagccatgtggcgaacaagaggaaaaagaccagtaaagcatcgacattgtttgtgcgcgctacggctacagcaatcggtgtacacgccatgacaaacgaagcgatgcgcgccgccgtttttccgaacgtcggctttattaataagtacatgaatagaactgaacctacccccgccaatgcctgaggcaggatgacactccacccgtgcataccgaatatcagcgcgctgatcgtttgaatctggtatgtaacaggcggtttatctaccgtgataaatccggctgcgtcaaatgaagcgtaaaagaaattatgaaagctttgaagcatactcgttaccgctgcggtgtaataaggattcaccgtatcgtcattccagatgttgtacatattcaagaatgcggaagcgagtaaaataaggattaagactgcgtctatctcgcgttttttcattttcacctgtgttttcactccttttgtttaactttgaacaagtgtaacaaccaaatgtgaaaaatttattaataaacaaagacatttattttgccgtttacaaataggtaaaaagaatgacaaaacgggtaaaaaagcaaaaaaaaagatgcccccgtcaagccggaaggcatctttcattacttctgatttactgaatcggtttcagccgcgcttctatttcagaacggcggtgttcgagataaggcgggagcgcaaccgttttgcctagctcttcaggtttttcatcaaccataaatcccggaccgtccgttgacaattcaaacagaattccgttcggttcccggaagtacagcgctttgaaataataacgctctacaatgcctgagttgctgaaaccttctttcgtaatgatgcggtgccataaagcaagctcctcctcattctgaacacggaaggccacatggtgcacgctgccttttccaggacgctcgcgcggaagatcgtttctttcaatgagatggacttctgtacgcgcgccaccgtttccggattcgagcaccgtaaccgcgccccggtcttcatgtgtttctttcccgatttcagtgaagcccagcacatcggttaacacacgcagcgtcggttctgcatacgggacggtcaattcaacgggcccaagaccgcggaaagaatattcttccggtatgccgctttgcttcaccgcttcaccgatgtcttttcctttttcgtcagctgtcagcacaagccgctgtccttcatgatcctgaaaagcgagtgtgtccctgcccgctattttcacgatctcaccgtgagagacctgatgctcttcaaatcgttttttccaatattgaagcgcttgtgcatccggaacacgcaggccgattgaagaaatactgtttgtccccgcatggaacggcgcgatccgcggaatctcgaaaaacgtcaattccgatcccggattggctgattcatcaccgtaaaataagtgatacatcgtcggttcatcctggtttaccgattttttcacaagcttcagccccaggatatttcgataaaaatctaaatttttctgcgcatcagccgtcaatgctgatacatggtgtattccattaactttcattatgttatcctccagtcaattatctcgatttcgagatattttatatatacaatttatgttatccggatcgtaaagtcaacccatctgcttcacagacggtctgcagactgccgctctcaaaataacgaacttttgatattaaaaaaccattaatgttcgcttttaaaacagtattttttccttctcaaaagcataaacctttatcttttaggcaaaacaccaaaatcagaaaatttattttattcgtgtttcagcaattagggtttacaatatggaaaatagttttttcagcataacgattttacatctggagggaaaggatatgcagattgaagagaatggacttaaaaaagagatcggccttaccatcgccctctcacttgttatcggcaccatcatcggttccggcgtatttatgaaaccaggcgccgtgcttgcctactccggtgatgcgaaaaccgcgcttatcgcgtggctgttaggaggcattttgacgcttgccggcggcttgaccgttgcggaaatcggcactcagattccgaaaacgggcggactttatacatatctggaagaagtgtacggcgaattttggggctttttgtgcggatgggttcaaattatcatttacggccccgccattatcggagcaatcggcttgtatttcggctctttgatggcgcacttgttcaattgggattccggctggtctaaattaatcgggatttcagccgttttatttttaagcatcattaacattatcggaacgaaatatggcggcatcgtacagggaattacgactgtcggcaaattgattccgattatctgcatgatcgtgttcggcctttggaaaggcgatcagcatattttcacagccgtcacaagcagcatgtcggaaatgaatttcggcgccgccatactggccaccttgtttgcttatgacggatggattctgcttgcggcactcggcggcgaaatgaaaaatccggaaaagctgctcccaagagcgatgacgggcggactcttggtcgtcaccgccatttatcttttcattaactttgcgctgctgcacattcttcctgcgaccgacatcgtcaaactcggtgaaaatgcgaccggcaccgctgccggaatgctgtttggcgacatcgggggaaaattgatcagcgtcggaatcatcgtcagcatcttcggctgtttaaacggaaagattctcgcttttccgcgtgtctcgtttgcgatggcggaacggaaacagctgccgtttgccggacagatttcgcgggtgcatccgacattccgcaccccgtggattgccgtgtcatttcagatcgcgctggccattattttcatgatcgccagcaatcccgataagctgtctgagatctctattttcatgatttatattttttacgtcatggcttttttcgccgtgtttatcctcagaaaaaaaagcggcggaaaaccgcgcgcctacagcgtgcctttgtatccgatcattcctgttttggccatcgcgggttcactgtttgtgctgatcagcacgatcattacagatacactgagctgcgcgctgtccctcttgatcggcctcgccgggctgccgctttatttttggctgaaaaacggcagaaaaaactgacaaaaacggttccttttacgggagccgttttttttctggcaaaatcacgtgcaaaagttgacagcaaattcacatcttttgttatactttttaagcaagatgtctgaattcgaagtatgttacgtttttttggcgaagtgggtaacataagaaaaacaggatgagacacgtttttacgaaaaaatcaagaggcgtttttttcgactttatctgttttttttcgacaaaaggctatataataatttgatgtgtgcattgtctcattcaaacaatggagggtttttaatgataaaaagaaaaaaagataagttctcactccttttaacagaaatcgcaaaaaacatagacgaaaccgcagaatactttgtcaactttaaagtgacgaaccagacgactttaaaggaatttgccgatacgttaaaagagtttgaaacaaaaggagataatcatgttcatgtcatgattaaagagctgaacaaagcttttatcactcccattgaacgtgaagacatccttgagctgacaaacagcctcgatgacgtgcttgacggaatcgaacatttttcagcaatgatggagattttctcgatcacttcttcagatgagcatatcgataagttcagcggatacatcagagagtgcgcgaaggaaattttaatcacgattgagctgcttgcagaaaaccgattgaaggacattcaccctcacgccattaaaattaaggaatacgagcacagctgtgataacctgcaccgtaaatcattaaaaaatctgttcggcacagaaaccgatccgattaaagtgattcagtaccgcgagatttacgaaacgcttgaggaaattgccgactcttgccaaagcgttgccaataaccttgaaaccattattatgaaaaacgcgtaacgagggttataatggatactctattacttttaacgatattaattgtcatatgcgctttggtatttgacttcattaacggatttcacgataccgcaaacgcaatcgccacctcagtttcgacaaaagcgctgaagccgcggcacgcaatcgtcatggccgccatcatgaactttctcggagcgatgacatttaccggtgtggcgaaaaccattacgaaggacattgtgaatccttatacattagacaacgggtcagttgtcattctggcggctctactcgccgcaatcgcctggaacttgatcacatggtatttcggcattccgagcagctcttcacatgcgattatcggagcgatcgccggagcggccattgcagcgtcaggttttgcgacgcttaattataaagggttcattaagattatcgaagcacttattttatcgccgattatcgcctttgttctcggctttatcgtatattcgatcgtgaagctgatttttaaagacagcaatctggcgaaaacaaataaacgcttccgcagagtgcagattttgacggctgccattcaatcctatacacacggaacaaacgacgcgcaaaaagcgatgggtatcattacgatggcgcttatgacggccaatttacataaaagtgatgccattcctttttgggtgcagctctcttgcgccctggcaatgggtctcggcacatccatcggcggctggaaaatcattaaaaccgtcggcggaaaaattatgaaaatccgtccggtaaacggcgtatctgccgacttaaccggcgcagccattattttcggggccacgtttattcatctccctgtcagcacgacgcacgtcatttcgtcttccattctcggtgtgggcgcttcccaccgcgtaaaaggcgtaaactggggaacggctaaacggatgcttattacatgggtcatcaccctgccgattgcaggtacactcggcgccatcgcctttttcatcttagatctctttttctgatgacatccgcttctttacagaagcggttttttttgtgacaggaaaatgatgtcatgacatagaatgaacatagcagaccatttttcgaattgtgagggatgctcatgcttttgttttttcagatcatggtgtggacgatggcggccgcactcattttatatgtgtacgcatcctggcggtatgaagcaaaggtaaaagaaaaaatgtttgccatccgtaaaacgtggtatttactatttgtagtaggcgccatggtctattggacatatgatcccgaatcgctctttgccgcatggagacaatatttgattgttgccgtctgctttgcccttattgatgcgtttatctttttgagcgcgtatatcaaaaagctcgccggcaatgaattagagacggatacgcgggaaattttagaagaaaataacgaaatgcttcactcctatcttgaaaaactgaaaacctatcaatatctgttgaaaaatgaaccgatccatgtatattatggaagtacagaagcttatgcggaaggcatcagcagactgctggccgcttatggagaaaaaatgaatgtcacggcttccttgtgcgactattccgcacaatcggataaggaccgcttgacggagcatatgcctgatgcggcggacgttcagtcccgtcttaaccgtaaagacgtctactatgatcaaaaaggcaggcttgtgcttattccgtttacagtccaggaccgccattacgtgatcaaactcacgtcggaaaacctgttgacggaattcgattatttgcttttcacatcgctaacgagcatttatgatttaatgctgccaatagaagaggaaggtgacggttaaatggagcaggcatttcaaaacgggcagccggaacaaagagcgaaaccgttcaaaatgtttaaaaaacgttcaatgacaagtatcgcaagttaccaggtcagccctcataccgccagaattttcaaagaaaacgagcggctgattgacaagtataaacaaaaaaaagcttgattacactaaggacaggagacacggctcttgtccttattccttttttccatatctttcatataataaaaccaacaaagagatgcgacaggtgatgatgtgaagaaaattgtcagacgcgtaaagtttgtggattacggacgcttcgggctttccgcttattcgctgaggatgcgggcgaggaatctcgggttattgaaccggttaaaaaagaaaaaaggctgaatcccgcaatgtgaacgggactcagctttttttgttaaagctgcatcagaattttcgcttttacagcgggaccgtagacgccgtcagacgtcagtccgtttacagattggaagcgggccacggcatctgccgttttcggaccgtagataccgtcaatgccgttattgacagctcctttttcaggatagaaataaagcgcggcgagcgcgttctgcacctggtataccttttcaccggacgtgtacggctctgtcagcttgatcacctcgtccggaagagaatacagtgcttcaaccggcgggctgacgatcagcacttgtccgactttaatcaagttcgggtcagcgatgttattccatttctgcagatcggccacgctgacgccgaatttccgcgcgatcgccgacagtgtatctcctttttggacggtatacgtctgtctttcctcagaaccgattcccgctttaaactcatcccatgtatccagcagtcttctcggacaaagctttcctgaccaatgcttgtgcgcaacgacattcgcaagcgggatgccgtgcgacgtcattaatgtgcggatgagccattgggcgtttgccacggcctgtgaaaagttgccgtctgcgttttcacaaatttcaataccgatggatttacggttgccgtccccgtttccgtcaccggcatgccagccgttttcgttcagcggaagatgctgataaatttccgtatcatcgactgtgaaatgccagcttgtcggtgtatcgggatttttcacatagcttgcgtgacttttggcgttagctccgactgcggtattggctgtattgtgcaccgtaatgtaaatcggtgtcattgcatagcctgggcggttattgtttcctgccgggataaaatcctgtgtgatttttaccatattctcatctctcctatttcgataaattgtttatttttaataaagcctgctgttttttcccttttgctgtaacataattgtttttaaaccaggcggcggcagtcgttatgattgtaaaaacggccgacccggcggcatacagcgtatctgcaagctggctgacctggtcctcctgaatattcagcggcgatttgccgaacatcagcaaagtttgattcaataaagcaagcaaaagaagcaccgtcctgacgaccgtgcctttgtccgcgaatttcatatcggtttcccccttacttttgcagcagattgtacatgatggcgattgctccgccaatgacgcccgtgcagattgctgtcacgatcgctcctgtaatggtccgcttaatccatgttgtgttttcgtcaattttgttcagtttttcattcagcgtcatgatttgctgatcctgccggtctgatacccgctctaatgcggctacccgctgttcaagcaccttttgttcacctttgatgtctgcgaattctttttgcaccgcttgttcatccagaagcacttccgctccctcctcttacattgttctcacctcccttcggaagcttcattcttaagaaaatgccgtgcctttgacagaaaggctcccgccggaaatgctcttgatttccatgacgatttccttaaagccggcaatatcaaatgaccacacttcttctgtgcctgacgtaccggcggctgatgtcccgtcatcagacctgattcctctgatcggcacattttttcccgagatggatctcccccaaaacgcgacatggcccgactcagccgtaccggtgatttcgacgagaagttttttccaagcgcctgctgagaagatgcttccctcgcccgcctctgctgcattttcatgaaaaatcacgtctgtatatgaaaacgccatatcaccgcccgtaccgacagattggtataaaacaaattcggactgcttttgatttccattttcaaaacggaaccggtaatatctttttgtcaggctgacccaccccgaagcggtcagcactccgccttttactgcgacaaaatgtgaagctgtccacgaattgttatcctcgctctcttcgataaaaagagttccgctgcggtccgaataagcccacccctgtgctctgtctattaagacggctcctaaacggtcttgtccgaattggctgtagacttcaatcgcttctagcggcgtattggtaagaagctctgccattccggacaaatcagcaaccggtgtgacataatcgtttttgttaccgcgataagcttttacggcgccgggcctgccaagttgatcggcgggaaattcaaatgaatgctttttcatcggccgtcctcctgttctcatttattaaaaatgacaaataaaaaaagccgtttggcttatgacacagcatttttatagttttcgtatgtttcacccgttatttcttgaaattcctcaggcgtgatatacttcgcggccaccccttcagccagatcttcggcagagcagtcatcatagcccatagcctgttttaccatttctgttgaggcccactcataaaacaaggcgtaaacccaaaagttaagttttttcatttttttcattctccttttacgtttaagagttccagttttaaagacgctaattgcctgccgagtgactgctgcgcttgttcggctgcttttctggccaatttctcattcgccagctgtccgccgaggcctgcaagctggtttgaatcgggagccgtatctttttttaagctctctttatatgcttcgtcagcggtttccacccattcttgtttctcttcatcaaaaaatgggcgccacatgccttcgccgtttatttccggcggaaagcccgcagcgttaggcggcatcacataatctcctgtctcagaatccggataaagctcaaccggagtgcctgtataaatgttgtcattgtcatacggaaatattaatttcatattctcgctcctttacgtgagtgccaaaacaaggtcaatataatagccgttcacgttattttctatattggccataattcccgtcagcttcatatctccattagaatagataataaatttgctgtaaccggtggtgccgctggctgcaaccatcgttacaacgcctttggccggcgcacaagaggatggcacactcccgaataccacttctctgtccgtaagaacgtgtccgttcaggtgaagggtgtttcccactttacggtattgaagcggcctgtctcctgatttagcgccatttttataaggaacatttatccaaggtacattctcagtatcaagttcagtaacgaggcgacgccagccctgccagcccaagttcaaatccaaatagttcgtgaacatattatttttataatcgacggcaatgacatacccaaacgttcctttcccctcactgtcaagagaggtaaaatgaaacatgccgcgggttgaagcgttgctcggactgtttgccgctttgccggttgaataaaaggtgccgaacgccctgccgtttttaacgattttttcaagaaagttatcatcatcaccaattgtcagaagatagccgccgttatcgtttgttattttcgaaagctgtgcgccgttccacatatctttatccgcctgtgtgacatgaatgtcttttttattggcgtgagcctctacttttgcttgagagcctgaatctgtttcttgttggctccattccgaccatacgcctttagtgctgaaacttcggacgtatatgggatttccggcggtcactgtgtctataaacatttggacaaaagtcggtgatgctccgcgggttctttgcatgacaattaattgtccgtattccgcaggcttattttctgtatgctgaactgatatatagtagatgccggacgtttttatattgtctaagtttgtttctgttaccgttttagcattcccgtcattgtcagtcagattgaataactgccctgcattccatttgtctttgtcagacttggttacatgaagatctgttttgtcggcatgctcatttacttttgcttgtgctccggcagctgtttcaaatggcatccattccgtccagatgccgtttttcagcgtttttctccaaaatcccccgtcatctgagaaagcggccgcctctccgttattctttgaagaataaaggtatataccctctgacggtttaggcggggtatttattccggttgcagctgctgagaaagtaaaggtcttattctggctggcagcggtctgatgaaaatcctgtccgtcagagatattaataaaagcggagccatcatcttttgtgattttagacaattgcccgttattccacttctggcgctcttctttcgtcacatgccggtccagatcttgattgtgccggtcaaaatctttctttgctgcctgctggacattgtccacgtttccgaggccgatttgcgcctttgtcgttttgtgcgggttgttcatgtcgtttttatgggccgccagatccgtgtgggcgttttttatgcctttttcccagcggttgacgtcatcttcattaatcggatcgtccggaagccagtctgttttttcttcgtaagccatcgttacaccacctcaaaggtaaatcttaaatcaagcgttctgttattgctgagatctaaatttgtttttcgttctgtaatgacgcttcctgtttcgtcaagcatctgcacggtttcaatgtgtttgacgtcttcttccctgcgtgtgagaacggtgactgcggcatcttttacggaaatgtccgcaatcggagtttctttgccgtttaacagcacttttgtgatcctgtttttcagatcggctgcggcacgctgtctgtaagcggctgatatcatggtaagaccacctcgttattgttgagtgtgacggaataaccgaccttcagttcactgacttttcggtatctccgattgttgagaatgacccggtctttgatttccagtgtttcgtttaatgcggctctcagtgtatacgccaaatgagcgggtttgattttttcaagcgtttcaatcagctcgttcatgtgctgcaggtcatcaagcccgatatcggcataaaaacgatactgccccggaaacatccgaacataagctgacggatgttttaaaaaacggtttagcgcctgctcgatcgcttgatgtgtgatgggcggaatattcgacatcttcgagatcagcctgagccgtctcatatcctccgtgtcacctgattcccgcggtatttttaatattttttcccagcggtcaagcccccatgtcgccgtcgtgataaagagctgatccgtcaaatcgaaaatatcgttattctgccgctcaaactcaggagcttccgccataagcagttgtgccatctcttttaatcgggttaaaaacggcgggaggtacgccgtcatctcatcgagtctgctcaaggattttcacctctttgagtttaggaatttccacgtcactgagcacgaggttttctgccgcaccgttcattttaatatcggcgtagtcactgacggatgccgagttataaacgatgttgttaatttgtgataaacggacggtgttttcttcaaaggccattttcttgaataaattcagtacgcctttttcaatctccgcttttacgtcatcgatcgagctgttcagctcaggcagcacggaagcggagatttcgatttccttccatactgcgctttccaccgttactgccgctccgatcggcgcctgtccttctccctgcccttcgtccggatcaatataatcctttacttttttgatcagaatatctgatgccggttccaaattcgcatttgtgatgacaactttcaccgttccgtctccgttccaaagcgggaagatttttgccctgccgacgccgtcaatctcttcggcccattgtttataatgctgtttatttgcgctgactgcctcccggcggacacgggtaaaatagcgcgcccttaagctgttgtcatcttcttcctcacggccgggaattaatatatcgcgcatgactgctttctcaagcccgggtatcgtatcaagcggcagcaggttctgccccgaaatgccggcattgcccgcttcaccggctgtttcacattcaagcgttccatccccgtatattgaaaatacaggttatcaacgaagaaacgggagcctggcggaatggtgatgcccgctgtgaattctccggctctgaccgctttagtggcaggtgttcgttcaattcccgcctcagcagcacgcctgtccagaaattcaccctgagccgtatcggaaaacacgagctccagcacggtatccagccaaatataagactttgcgagctcagcggccgcaggcgcgagcgcattgtaaatgacgctgccttctctcgtatcaatatccgccgtaacgcgcgccagcattctgtccataatgtcgtcaaacgtctgagcttcaaacatcctcacccagcacctcctctatctcaagcatgccctcatcagtttcaacggtaaaagagacgatgaaggcatcatcttttttctcaatctcaaaattggtaacggccaaaatacggtcatcatacagcaaggcttcttctatcagtcttggaatctccatttttttataagcatccgtcgtgttctgatctgaaagcacttcctgaagttcgtttccgatatcatggctgaaaaccgaatatgaataccgttctgtgtgaagagcgatatagacgaattgtctgattgcgtccagtccgtttatcagttcattggtaatccggttgttttcaaagtcaattcggtaggtttgtgaagtctcaacagcctcactcgcatcctccaaatcttcaaattcgatttccggtgtcagggccattgcacccgctccttttagatttgttcatgtaaaaaagccctcttcggcagatgaagcggctttaataggctgatattcccgtatatctccgtccggatgccggttaaattttgtccagtacaaagaaagactgtcctcctgttaaagcggcggtcatcacccgatctcccgcctggagctgatcatcttctccggatctcagccgcttcggcacaatgagtgcatcagacggaatcaaaagtttgtcgtgatctttcagtttcagctcgagcggcgaaacggaggtcacttcggccggcatcagctccaccggcgcttcagcgtcaaccgctccgacggctaaatgtttaatggcatcacttaatctcatcaggctgtcccctccggaagtgaatttttctccgtgacgtcaatcgtcatggtatgttttgttccttggaattcatggcggtccgtatctacataataggttttcttcagcccgatttccggaattgaaatatagacgggcaatccgctttccaacccaggaataccgatcgcctgtatatttttcagctctttcttaatgccttttttctcagcctgcttcacttttgcgcgctgtttcagctgggcttcgttaatgtcgtcagaaaccgtttcggtatactgcaaaacgccgaatgttttcatgccggcgctgtctgaggcggaagcctttatcgttttattgtctttttgcagccgcatgacgacacgggttgcggtgtcatcaattgaggtgctgtattgataccctgtaatattaactcctgtttccagcacccatatgtcagacggctccggccattcacgcaagccgagcctgcctttttctgaatagagctgataattgcgccccgtctggctttttgtctgctttaacgcttttagcatcatatcgtaaaggcttgtatcatttttaaaaacgagtgatttaatagtatggcctgtgttggcaatggatgtgacgggaatttgaaaatcgctggcgatcctttttaatatttgatcagcgcgcttgttggaaaacacgtaaacgtcctggtttttcacaaggtattggagcatatcgtatgcggtgaaggcgacggtatgctcatcgggcgttcttgcaaaaacaatgccgcggaacagctcttttccgttccatttgaacaaaaccgtatccccttctgatacgccgtaatacgtctggctgccctgctttacgacaatcgtcgcttcgatggagcggggcgcctgatatctgtgtccttccagcgttacgctttctgtgacaagctcgagccactccgtttcttttatgacaaatagttcaatcatcttttcacccgtttcattgcggtatcttcagcttctgccccgggaagatccaatgccccggctgccggatattccgtttgctgcgcttaatcatggcggttttattcgcgttccagattttccgccactccgtgtgttttccgtaaaacttgccggcgatgtcccaaagcgtatccccttttttgacggtatatgttttgggtgaagctttggacgggcgcttcgctttcgtttttttcttttgtttgatttttcttggcgaagcggttttatattctttcagtacgatatcaaaattccggtcgccgatttcattgtcaccttcgctgtaattaaagctttcaatgctgcatgtgacattgatttttgtccctgtaatcaaaaactgaacgggttttttcgctttcatccatgcttcaatggctgaaatggctttttccggtgaaggaatgctttgatattcggcaatcgggctgtaccgtttcggaaaaaaagaagagaacgaaatttctttcgctcccggttcttcgataaacgtcacctctccaagtccggtgactttcacggaatcattctgcacgctgtttgcgatatcaatcgcttcagggagaacgggaagccggagcttgtccttcccttgagacagccaaaattcgtaaacagatttagtcaaaagcaacggccccctttgctccggtataaatgtctttttgcagttcatcaatcagcgcctgtttgattttggcggctaggctctcggcgtcctgcccgttatggaaatgctgatcgccgctgaattcgattttaatttcttttgttcccgttttttgaacggtttggccgccgcctttaacggctgcggaaaccgtgccggctgaaagcgccgccggttccgtccgggacggatcggacacttccatgccgagcgcctgagccgctttttgcagcagataacggccgcggatgccccgctcttcagggatgatccactcccgtttgttcccttcgccgacacgggcgatctgctccttggtaatcagacccccattggcataaccgacgtaagggccgccatgagccatacttttaatcccggggacattgctgatcgagccgtatcggcttttaatatagccgatagcggcagcggcgttgtggattggatttctgatatcattcatgcccggcgctttgtgatcttcaaaggtgctcggaatcgtctgcataagcccctgtgacgggtgtccggctttggcgttgctgtcccatagattaatggaattagggttgccgcctgactcatgctgtgcgatcgtcattaatcccggaagccagctgatcggcgtattggttgctttcattgcggccaaaagccattctttgacgcttcctcccgctgcacccatgccggaaaaggctgctgcaagcgagcctgcctgtttttccgcatattttttcacgtcaactgagctgagacctttgacgacgccgactgaagcaaagcgtccgagactcatcatgacacgggaaggagagtgaatatcaagctcttccctgaatgcgtcctcgacttttttggccatatctttggccgcctgtttgacttcgcttccttttgcagtcatccctgatacgaagtgtccgatcaggcctgaccccagccgttcgcggaatctcttgattgaacaaacggtttattgatatgtgtgcttacgtattgcgacgttcccgtatcttttgcattctgtccggccgaataacctttcactgtggcggcgccccatgatgacgattgattaacctccgattgataaggtgttttcacctttgtttttaaaaacgaatcggtgcccgtcggcgatgtattctgacctttggcatagcccgcagcgacttgctttccgtaatcgggcgaagacgaaataagggcgttaaacggcgttccgatgtttttctctttccagccgtccatatccaccgctttattgctgattccgctgtcaaagccttcagtaaactgtttgccgagtgatgaagccgtccccgcaaatccggaagcatccacagacgcagcggccgatacagacgccgaagaagaaacaccgcccgctcccgccggcacagcggaagactgagccgaagccgcgcccatatcatcgacaacacgcatgccgagcttagacgcagcttgtgaaagcagcatcttcccgcggccgcgattgttgtcgacggggatgacaaattctttaccggcttcaccgatccaggaaatggtcggctttgtaatgtagccgcccgtggcgtttttgtccgtttttttctttttatctccgccgcctcctgtgacaaagtccattacgcctgaaatcaatttgccgccggttttatcccaaatctttttcacccagtcgaatgctgcagaaaaagcatctgatatggctgttcccacttttacaagaggttcttttatatgtttctcaaaccagccgcttaaccctttccatatatcctttaccgtatctaaagcagtcgtgaaagcgtctgatattccttttccgactttttccaccatgtttttcaccgggttccagacaatatccatgaaccagccggataccgtactgaaaacagatttaattttatcccaagctcctgtgattttactccaaatggacgtcgctactccgacgacagccgattttacgggctcccagacagtgctcataaaccagccggatactgtgctgaagacaccttgaatcgtcgtccacgcattcacgatatttgaccatatgcttgtcgccactccggcgacagctgatgaaaccggcgtccatacattctccatgaaccaggatgacaccgtgctgaaaatcccttgaatcgtcgtccatgcattcacgatatttgaccagatgcttgtcgccactccggcgacagctgatgaaaccggcgtccatacattttccatgaaccaggatgaaacgcttccccaagtatcttgtactgttgtccaagcactttgcgccgcttcggaaatatcattccatgtgtctttcaaagcccctgaatcaaaggcctctcccaagctggaaccgcctaaactgccggcgatgccgcctaccgcgccgccgattaatgtgcccactccgggaacaacgctgccgattgccgctccggccgcggctcctgcaagaccgccgcctgctgagccgaccttctctcctgcattatctttattgatgccggctaaatcagtaagtgataacaattcacctatgccgggaattcctttagcggcaccttttaaccctttcataccgcctttcagcgcctttgaatctcctaagcctttcaaaagcccgccgatgcctttacctgccccttttgttttcggcgtgtttacggatgcctgtttgctttcctttacggaggaacctcttttcgaagatttattccgcccttcgactttactgcttttgcccctcgtcactccggtacagcagcagccgccccccaaagccccgccggtttttttggctgaccttcctgaagatttcggtgatggtcccgtgcgctgcggaccctttgtcagctcaggacgcttcgggctgttggtgccgccggcagaaaggctccccttactcttttcttttttcgtgccgcctcctaataatccgccgatattgagtttgcctaatttttcagcgattcctgaaaatattttttctattaattccccggctttttcgatgattttgtccgggctgaatttctcaaatttcttggcaatcttgctgacaattttatcaacaaatgcctcggctttttcgatgatcgcatcagggctgaacttgccgaactttttatcaatgcctccgaacagtgaggaagtaaactgctccactttttccagaatcttatccggattgagaaaatcgaatttctcagaaattcggtcaatcgtgtcatttacaaattgttcggcgcggtcgattagcttatcaggactgaatttaccgacaacgtcgtcgactttcttcataaacgaatcagtaaaatgatccagctctttcaatatggtctccggactgaatttgctgacaacgtcatcaacctttttcataaatgaatcagtgaatttatccagttctttcaatatggcttccggactgaatttactcacgaccccgtctacctttttcataaacgaatcagcgaatttgtccagctcggctaatatcgttgccgggctgaatttgctcgcgatttcgtccgcttttcccatgaataaggtcgtgaacttatccagctctgctaatatcgtctccgggctgaatttgcttgcaatctcgtccgctttccccatgaatgaggtcgtgaacttatccagctctgctaatatcgtctccgggctgaatttgcttgcaatctcgtccgcttttcccatgaatgacgtcgtgaacttgtccagttcggctaatatcgttgccgggctgaatttgctcgcaatctcgtccgctttccccatgaatgacgtcgtgaacttgtccagttcggctaatatcgttgccgggctgaatttgctcgcaatctcgtccgcttttcccatgaatgaggtcgtgaacttatccagctctgctaatatcgtctccgggctgaatttgcttgcaatctcgtccacttttcccatgaatgacgtcgtgaacttgtccagttcggctaatatcgttgccgggctgaatttgcttgcgatttcatccgctttccccatgaatgaggttgtgaacttgtccagctcggctaatatcgttgccgggctgaatttgcttgcgatttcatccgctttccccatgaatgaggtcgtgaacttgtccagctcggctaatatcgttgccgggctgaatttgcttgcgatttcatccactttccccatgaatgaggtcgtgaacttatccagctctgctaatattgtctccgggctgaatttgctcgcgatttcgtccgctttcttcataaagcttgcagcgaatttatccagttccgctatgattgtttccggataaaatttggatgcgatatcattgacttttttcatgaaggtgtctgcaatggagtcaagcattgaaaaatcatttttcggcgaagcaggagcagcagatgcagaagcttttccgacgtccggcatattcttttgcattgcagccagctgtgctgtcaccttttcgtttaacgataattgaatgacattgtttttccccgtcagcgaatcaatccccgctgaaattcggccgactgttttcatgacgtgatctatgacgcgtatagtgacagagtacccgttctttaacgcagattgcatgtagcgtttgatacgttccatggcaggagtcacttcgtctgacgcatacagtgaaacggtaaatcctttaaaaccggcagccagatcccgcaatctctcaaatgccgctgtcgcgctgtcttttgctcctattttaacggttaaagacgcaggcagacccgctaattgggcttgcaccttttgaatgacggcactggctccgtcttcagctgaaatagagatcatttgtgcgcccagctttcttttcatagagcgctggatgcggtcaattgttcttaaaacagatttactctctttgcgtatatcaatttcactttggcgttttgtcattttcctgtatttctcaagcgctctgaagccattttggattttccttattttctttgaaacccgatcttccaattcaaaacgggcggtcagctttgccatgatgtcgctccccctttcttcgcttgtttttcaagaatgtccagcttgtaaccgattaaaccgtacaacagcgccttaaaatgtctcggtgcttcatataactctttcagttctgatggagaataatgaagctcatgcatcgcgtaatagagatacacggcttccttattcccatcttttatcagttttttgcttcttgctccagatcttctaattcatcttcaaaaccattgatctcaatcgctttattcagccaatttgcatactcaccgccgactgaaagaacgcgttttgccacctcgaccggatctgccgttttgtaagcgtcgcggagctccttagaccggaaatcagggtaaatcgtagattcaaccgcgatccgcgcatagaagcgctggctgtctaagtcttttacgcggcctctgcccttcacatttttatatgtcgtgctttccttctccagttcgtcaatgcgctcagtcgtaatggctttaaaaataaaaggcacgatgtttccttttttatcgacaaaacgctttgaaagcggaacccggatctcctcagcctcgactgttttacccggcataaagaatgacagatcatatacttgttcgtttttttcgctcatgatgaaaactcccttactctttttttataaaaaaacaggcctataaaaggcctgtttcactcacaatgattctggttaaaacgtttcagaaagcttttccggcacatcgaaatcttcaaaggtaaacggcacttcttcttcgagggcttctgagtctacgtccagtccggcgatttttgcagaatcaaagttgacgtcatacagggtgacgcgttctgttccgcggcctgatgatttgtcgtcaagaacggcttgcagcgtaaaatacgggtcgctgccttttttgacgtaatccatcataaggacggcgaatttggatgtgaccttatagaatgttgccgtgcccgttccgttggcgcctgttgttttatgtcccgtcatgcggcggcccatgatgtttacttctgatttgtttttttccacgtttgcttcaaaggttttaatatgcgccatctcttctccgtcgagaaataaacggccttcttttcctgaaatcgtgttttgcgcttttaatgccatcttagtttacctccacattaaagtagaatttttctgccgcatccacaggctgtacggcgagatcgattaaaaagccgtcgcggtcttcattcagcccgattgtaatgtctttgtctgaatcaaagttagcgatgccgcccgcatcctggagcgttgtcaaatattgaataatcatcgttttgacgaattgaaggccgtcatttgtcgcaggaagatcgcttccggtgccttttttcgatttaattaaggctttcagttcacgtgtcaaatcgttattcaccgcatcaagcacacggacgattttgtttttcgcgaactttttgtttttctctgccgtaaatgtcaccaatgagttgatatctttttcaacgctgactgacttatcacgggcatcataagagaaaaggaattcacctttggaaagacgttcgatcacttcatcatgagtcaagcggtgcagcacatcgacggcgccttcgtattcaacgaatgttaaggattgattaaatgcggcgctggcacttgcgcctgccacccaggcggtcgcatcttcagctttaatctcagttccgtcttccagcagcacaccttcagtcacattgataatgccttcataatccccgctgtaatgggcggtcaccccttgcactttctgtccctgcgcatcgcgaaggcgtttaatgaatgcggcaaatgtcgctttcagctgatcgttttccgcgacaggaagagcgatgacatcgaaattctccgtttcagccgcagctaaaaaatccgtatagtctgagttgaccggtgctttatcagttcctcccgcgagacggatgcctgcctgcgggtttaacgtttccccggattcttcctcagtgcctgtcagcgggatggaagccgacagttcgcccgttcccgtaaatgtgacatagccgtttgcttttaattcttcggcttttttcaccgtttgtttgtcaacttccgcttcatccatgtaagtggtcacatcgaaagcggtctgatcaaggacgttttcactgatgcggatgatgatgtcatttccttttgaacccccgtacaaagcggttgctttaacaccttgcgaaagatctgcgctcgctctgattccctctgtcagacggtacatcaaaacggtttttgctttctttttcgcctcacgaagcagaatcagtgacggatcttcaatactgagccccacttttttattcaaatcctcaacgcttgaaatggaaacgaatgttttcgcttccccccagccggatgcgacgggaagggcgacaatcccgcgttcaccgatcgatacccgctcctgggcggttgttttaaagttaaaatagattccggcacgttctttttcttttccttgcgtaaatgttccgccgttcattattgcatgacctccttggttaaaaatgcttcaatgtaagacttggcttgcgcttttgtcatttgtttttgcttcacgccgaataaagcaccctggagaatctcgggttttacgccgaaaagctccttcgcgtgctttgttaaatccgccgtgtcataaagaaccgctcgttccgccgttgcggcgtttttctttttatattgtttcacttttgtttcaccccgctgttaatgtccacatcccgcagtgcgggagatgtttgtttttgatagtagtagcggctcgtccagcggatggtgatcactgcctcgcctttgtctccgactcttgtttcgatacggctgatgcggacgaaatcaccggtatcctcccctgattccgtaagcagcggaatcagctgtcttgattctctcaccgcatcggcgatcccgtcggctgcatagagggcctgcaccgagtcggcatggaacagcttcacattcagactgtatgtcttcttaaaggtggagactgtgtcattctcgtcaaaagcatacgggggcgggatgtaaagtgacggcacctgaaattgttcaggcagttcattttcatatacgggcacgccgcactgctgatacaaaaaagcggcgattgaaccggtctcgcgattcatccgatatctccccccaacgtgttaagccactgattgaaacgcttgtccagcgattcggcgaagagtgtttcatacaaaagaagggctttgtcccaaaacccatttccgctgatccactgttttttgagcgccattcccgttgaagctgacggatcatagatgaaccgggagccttgaaaatacccgggcacccatctgacattttcatctgagacggtccaatgtccgtcatttatgaatgaggcatactctacattggtgccgatttcaagggtcagtcccccgttttcaatgatccatacgtgatcctgcgctcctttccggaaagaagacagcaggctttctgtatcaatcccgcccgaatgaataagctcctcccgtaccaagtcgagaaaatcctctcctgactgttccagccattcgcctgcctgacgggcaaattctccggatgatgccttttgcagcgaccgattccattgttcaaggttttttatgctcatagtctgtcatctctcacagcgataacctcccaatggtgctgtcttgttttcttcggcatttccagaatatacgcctgtccttcccaaatgattttgtcattgacacgcacaacggcctctttcggaaaatgaacgagaaaccgctgatataccttatgatcaggctcaagctgaataagctgctgctgtttttcaacaaacagacacggcacgtcttcataatcgggcacttccggataagaaaagacaggctggagcttttcggcgggaatcccgaagcgtccggccttcggaactgacaccgtctcatgataaatatcgcatctgtcagtgagcagccgttcgtagctcataaaggtctcacctttgcgtgtgcagaaaccggagaataacccggcgcgatatattcacagagcagatggtgcaccgccggttttctgattccgccttcacctgccaccgtatacgagtagtcgcctatcttttcagattgataggcggaagcggctgcttcattctggttgatcagcgcaaaatattgagaaagctttaataacgcaagcttaatcttttcgggaagcggtgagtaaacagggtcagtgaacgaatgccccgccattctggccgcctccgcctccgcctccagaatgtcctgtataagaagcggctccggcctgtttttgacttgatcataaactgaatatgaaacaacgtcagacggctgaattaacataactgccacccccgtcttattctttaacgtttacgattttggcgcttgcatcttcttcttcaaatttgctgtcaagtttagccgtcagtacgataataaatttgcggctgcgaatatctttatctacttcgattcggatatttcttgaaaaaccgagaatgatatttttcgggtgagtcaaaatgatgtcagacgcatcgtactgggaatcaccttctccgactgagtacggctgcagattggacactcctttgaccggaacgccgaatgctgaagacaaaccgccctgcaccgcaagatctcccagattggtctgacggtcagccacacggtctttccattcaatctccatgccttgagatgtgtaaaatctgaattcctgaggcagtcgcaaatattttgccggaatggcttttaagccttttttaaatgtggctctggacagctcttccccgtttccgtcaatgacgtgagatacagtctgcttacggattccgtcaagctgtgccaagtacggatcagaagaagatgtatcgccgtttacgactagctcctcaatatcgactgccgcccgctccgccaaaatctgcatgatcgtctgctgcaggccgtctttttcaatattgttttcaagcgtgtcataggtgatattaatttccgcaatgacttctttcgtattcagctgcaccgtacttgttgacgggacggtcagctgatcgtcagttaaggcttttccttcctcagcggcacgcagaatacgctggccgaaaccgattttttcaaatttctgcgagtcattttccatttgaatcacacgcgattcgctgaaaatggtcggcgtgttctgcaccatgcggataaatgctgaagcttgtgcggggttcattaaaccgccgctttttaaagcggaaagtgacatttccgcctttctgatgatatcttgatttctcactctacagttcctccttctgactgggcttaaagcagtccgctccaaatggattttttaacaggctcttgaccgcccgtctcttcttccggctgctttgatgcgcctcttactttttcaagcgcttcaatgcgtttaataatcggcgccagcatgtcctcaacaagtgttttcagcttttcttcatcagacggcgcagccgccccgtctttgtcttccgtgttctggtccaaactgtcaagccgctttaaaagcgggtgcagcgcgtgttcaatcgattctcttacgtcttcttttctcatcttgttcaagtcctctcccttgcggtttcttgatttgcggtcacggtcgagaaattgcttgactgcgccgaataagccggcttgcttttctgccggctcttcgtaaacgtcagcggttcccgccatgctgtagcccgtaatgataccggctttaatctgatcccatacttcatcggaagctttggtgacaagcacccaagatcctttccggatcacagcattcccgatttcaaagtcatccggggcgacgtacgactccaccacctcgccggtcccgccttcaaaattatgatttgtatcgatgttgcgggcgtccgccaaaaaaccgtgagcggccttttcaatctcttcagccgtcatataatcgccatgtgcatcggggacatccggctcgtaaacgatgccgtaaacaagcttctgctcatccgattcgttttttgtaaacacctgcacctttttttcaaatgacggaaggcctccggctgattttgtaaaaaagaattccgtttggttcgccgccttatcgacatagctcacaaaactgatgacggcatttctcaattctctcggcacgagatgttttcaccccctttcaggattgctcctatttccctttcagcaccggccggctgtagtactcttcaggccattcctcaagcgtcttgccgagcactcttcccgccagatcacggaggtcattaggagagaccgcgccggcggaaataaatggcgtaagcaccttcgcaatttcaagcggatcgcgaaaatcaggcccttttaatgtgagctgtacatcgtggagacccagttcaggcaaaaataacgtgttgagcttattaatcagcgttttccgctccggctgaaacacctgctcctccgttattttccgtgccgtatcggctgtggctttgttgtattcctgcgcctctcccgtataaagcggcgggagacggaaagcggaacggagtttatttctgcttctgtcgtcatattcaagaaacagcgcatcatcctgcagaatttccgcaagtgatttaatttccacagacacgggcgtaatgtcttcgcctccgtgaaggtctttttccttcgcaatgccttccgcctcaatcagcagaaatttgtgggcgttttccaccccttccaggtcattcatataatcctgaagctctttgtacgaggtttctgacagcatgccgttttcaaccgtaatggcggccggcacgtgacggccctgcttgaaatacataaaattcagttcttccgctttccgggcgccgtacagattgacgatattgccgacccagcgcggaatgccgtaagtgccgctgccgatttttaagtgaatggcttcatttgcccggtattcttcagacagggtctttacgtattcaccggttctcatgtccatcatgcggggatcgccgtattccttaaaaaacactttccgtccgttcagcatctgaacatatttacggaaccgtttttgccttttaatcgttttggatgcgccgttttcttcatatgaaaatgtaacttcaacgggatcagtcacaccgcagacgcgcatatgtttcacatccagatattcaatccccgccggttttcccgcgccgtcccgaagcacttcgagaaaaccgttgcccgttttttcgcggtcttctatcgcatatccgaggaccgtctcggccgattcatcaaaatgaagacatttgtaaaagctctccagcttcatccagtttttttcggcccgggcctttttagacggtgagcaatctgggctatttacatcaaaggtatattccacatcgaacccaaaacccgtaatattgacccgatacgcgtcaatgcactgctgaagaatcgtcgagtattcggcgattgttttcagttcaatgagattatagggcggtgaaatgatgtcttcgccgtacagatcggcaaattgatcttcgttcatctgccttgcctgcggcgcggccatttttgatttaaagacggtggctctaacgttttgatagttaggcaacgcctatctcctcctttcccgattcggacgtctccgtttttgtgatgcatctttcagatccgccgcgtcatagtcatccagcgcataccaaatggctgaaagtgtgtggggatcaattgaaaactcatcttccgacagaacgccgtttttgttttttgcgtacgttaagttctgcaattcgcggatcgtattttcacagctgtctgagcaatagatatgtttgaaccgtttcagcttttttgtatactgaagtcttgagcccggaaactttttggccgcaaccatgcaaaatccctgcctgcggaaatattggatgcttttcggctcagccgaatccgctttgatcagctctttttgatccgccaattcttgaagctcctcagctgtctgatcatcggtcattttgtttttgtaatactcccagaaaatataaagctctttttgatccggatcgacggctagccggatgaccgcattgtatgactcttcaaaaccgaaatccatgccggtccgaaacagggggcgcctgatggacgcaatccgctccgttacttcgttgtgctccatgacctgaaactgcggaaacacgcggatgccgttgacgccgaaccgtcctttgcgggcgatccggtacaaatcaggatcgtaatgccgtaagctgtccagctgcttaatatagcttttcggcaaaaacagattatcgcacgctgtggaatggtggtaatacgtatctcccttaacgacggtgcctttttcatacagcgtctgatcatccaatacgaaccgttttttttggtcatcacgaaaaaaatgccggtacgtccaattggaggtgccgacgggatttgtggtgcatatcatatgcagcgaaagctcgggatgacgcagacggccgatcagctccttaaagccttcatacttcacttcagagcattcttcaatccaaatcagtgaaatatgatgaatggatttcaatttggccgggttgtccatccctttaaacataatccggcttccgtttgaaaatctgagctgcatcggtgaagaaacggcctttacggcatgtcccagttcaagctccgtgataatgtcttcaaataaggcaaacgtagaatccctgtgcgtatcgaaaacttcccgcacgacaagggccgtccgcttttcacgaagcagcttcaggatgattttcagcgcggtatgatagctttttgacgagccgtagcctccgacgagaaattggtacgtttcattccaattgaacaaataatcttcaaagcgcgggttgaccgctttttcaatcatggccgttcctctttccgcgtaatgacaatgtcaatcggcttttggctgtcttctgttttttccatcttctgctgtgccagctttaatttttcattttcgattttttgtttaaattggtcagggaaaaggtcaaagtacaaggacagcttttcaagagccttcatcttgtccgcaagctttattgcaatgccttctttcccgagttttgcttccgtgacgatggttccgtccagaaggtgcgaatctttaacgtcaacgtagctgatctcctgcataatcggattatcattctcgtcaaagagcggccctgattttccgaaggcctgaacctctttttttccgaaggttacataatcggtaatgtcagcgaaagcgattttcacatagacttgaagaacgtccatcgcttcgacaaacactttattgaccatttcctttttcatgcggctgatttctttagcgactttttcgttttttaacagcctgcttcccgtcacatgcgcgctttccggtgaatacccggcttttatcgcagattgggtggcgttaaagcatttcacataataaagacaaaacagccgctggcgttcgtttaactcatcaccttcgcccgggttgttttttccgccgctttccgcgttctttttaagcgcctcgtcccagcgcccttcttttttccatctgccgattgttcttgcggatacgcctgatttgccggcaagggcgcgatttgtgatgcggcctttatgagactgatagattgtaaatgcctgttctctttttgcgtttttcatgctacggcatcaccgccacctccgacatgattgtctataataaaaagcggcttctaatcgggccgctttttgtgatcgtctgttcacttctaggtggcaaacgtatgacaacttatgaagcaggcgattgatttctttgttcctgctgtttttgaattttcagaagcgcccgtttgaccgtcgtttgtacggttgatttctttacattcagcaaggcggcgatccgttcatacgaaaagcattccgctttgtggagcagcagcatttctttttctctatccgttaaaacggctaatgcgtcccgcagtctgattctgtcttcttcagtcacatttgcggacggttcaaacatcagcgcctgcgaataggtttctatgattctcggatctttaatgagcattctctgataagcgtctctgcggtctatcgctcttcttatgccgggctgccggcctttttcaagccattcgatgacatattccaaatctgtaataatcgttctgatgatttttttatctttcagttcttctgaagtaaacaccgtttcatccgctgcctccagctgcttgtaccactttttcgtctctttcagcgtgcgtttatattcaaatagtaagtcttccatgtagatcctcctctttttcggaacaaaaaaggacaccaatcaatgcgcagcatgtgcgcgattgatcagtgtccgcaggctttccgtcttggacgtattctgtttttttcgattaattcaatttaaagccgatttcatattcgacccgggccagatccccttttcgcgtttcgacaagcgttttgccgtgctccggcgcttcggcgagccatgcttccttcttcagtccgtctactataatcacccgaaccttgccttcttccagctggctttttaatgttgtatgttcaatgtcagtcagttttttaggattcatgttttacttcctccatctttttcaaaatgttcacttcatgtatgaggcttccgagctcatttatgaacgcttctttttcttcagaactttctccccggagcaggcggagagccgtttcggccgcctcaaagagttccggggctttcgccatcaatgccgcgttgatctgctgtgagtatgaacttaagttgaaaacggccgcgatgagccttccgtttgaataagggaacttctctttatccgcttcgctgtaagcggaataaatgtaaatgggtttttcttctccgctgtgtacggcccgccatggagcggggctgtttttttcttgcaatggtgatcctcactttccatcagcctcatgccatgcttcaatttgcttttctatccgttttgccctgaacagcaggcaaaaaagccatttgatatatttacacacgtgcatcaagcctcgcttttgcgtcttgaaccattcgttcaagccgtttaatgaccggcgttaaatcagtgcctgttttgcagttcgggcaagggtgaaagacagcgccgaaacccgtttccatcacaatgaccttcttcggcccgcacagcttacacattatctcgccccctctaatctgtggtttacgtcaaatgaattgccattaatgatgactaaataatcgctgcacatctcataaattcttgtgcccaaggcttcatcaacctgcaccaatccgtcacaggccagctcgctcgagataagaaccggcttatgatttaaatagcggtaattcacgacggcgtacatttgttcaatctgccaatcggtcgcccggggttttccgttcagcggtttgaacagatcgtcaataaaaagcacatccgcctgtttcatacggccaagctttgcatcgagcagatcaaaatcattttttaaatccgtaaagccctccacaaaaggaaaatacagcaccggtgtctgcttctgtctcatgacataattgctgagagcggtcaaaagatgggtttttcccgatcccggacgccctaaaagggcaatgctgtttttccggcagtttttcatcttgtcgaagttctcaacatattcaagggcgcactcatatgcgtcgacgactgcctgaggcttgccccgcgtgataaatcctttgaaatccagcttccgaaaggcatctgtaatctcacttgcgccgagaatgcgttctactttccgttcggcggcgcagcggcacttaacccatacttccattcccagctggtttttgagataaccgccctgatctttacagagcgggcagtcaaagcggcttttgtctgattcttccggtctgtccgccagtaatggacgttttccgtttttcaggtcggcaagaatctgctcgatcgttcgttttgtcatgtatcgtattcctctctttttttgttgtgattgtccttcccgcaattcgtgcattcaagcggtcttccataaacttggcgcaatagctgaaagccttgatcgtttcagctgaagaggtgcgccgctgttcaaaagcggtaaagcattcgccgagccatttgattgcttcttgtgctgacgcaccgagggaaacaatacgggcgatggcctgataatcccggggcgacgggtatacgctccgcccctcctgtgcagaccttaatctgataaaatgggcagcaatgtcgttaatcgcttcttcagcagtatgattttttgttatatctatttctctccggacatttttgtcccggtgatccgccgatattgtccggtcagttgcttccgggcgggttaatgtctttttcggcgtgaatcttttcgagtgctttacggagacgatgagtccgtaaggggcgcggacggttttgatatactcatgctgttccaagctctcgagccaccgcctgacggttttttcgctgaccgcgaatacatcggccatttctcttgcttttacgggcttatgtccgaggacgatcccccactttacgccgtcttttacatgttcctttgtcgttgagctgatgaaccataaaaacagccaaatggcggaccctattttgtcataatgttctgaattcaataatccagaatagatgaaaaacgggtagcttttacgtttcataagggacatctccatttttcttcagacctatatagcgttcatactgcaatcggttatcaaatcggaataccggtagtccgcaagcggtaaaagatatcgaaccgcctgcttttcctaaacatctctggtcagccggattgctgctgaaacggatgattatcggctgcatctctcaccctcctgatcaatttcttatcgtattttgatacattttgtatccctatgatgttgattatatacgatacatttcgtatcatcaagacctttttgatactttttttatcatctctttcttttgatacattttgtatctataatcataagtaacttagggtgttgaaaaaagagaggtcatttcggatgataggcggaagattaaagagtctcagaggtaagaaaacgcaggaagaagtcgcaaatcatatcggtgtctcgcgcgccagatattctcattatgaaaacggccgatctgaacccgattacgacacgctgcaaaagcttgcggattatttcaaagtgtcgactgattatttgttaaccggaaaagaaccttcagatgaagacatgtttgccgatcccgacctgcagatcgcatatcgggacatgcaggacttttccccggaaagcaagcagcaggccattgaattcattaattatttaaaagaaaaagagaaaaaccgcaggccgaaacataaataatccgctcttttcctttaaactgcttaacgttcagccgatataaaagctgaatgtttatttttaaaagaaaagggaattgattcaaagtccgatcagggcttttctttctcgcttaaaaaagaacatatgttcgaaagggtgtattcaattgggcgattttttaacacatcttgaggaatacgtcaaaaacttatattgccgcatgggaatgaccgcccctctccatattgatatgcagatgattgccaaggagcttgacatttggattcattttgaagatacgcacagtatgatgctgaagcgggacggcatgtacagcatcgtcctgaatcaaaaaaagtcacccgaagagcaatggcaggattttgcgcacgaactgtgccatgtgctgaagcataccgggaaccattttcatatgaacaagctgttcagggaactgcaggaatttcaggccaaccattttatgtaccacttctgtgtgccgacctttatgctgttaaacatggagctgccccagcggaggagccacgccgttattttaatcgcagccgctttccgggtgacggcatcatttgcggaaaaaaggctcgagctgtttgaacggcgtaaagcaggtattcaatttcagaagcggctcgcttgtctgttatccgacaagcggccgaatgtgtattatggaagcggacagacacacttgcatgccgctgaagaaaaaacgccgtattttattgaaaattagcgattctccgccggcttagaacacagccggcagaatgtcatcattttgacatcggagaaaaggtttttgcatcatgacgctgtaatcaccgtgctgcccgccaagcacttcatgcgccgcatagctccagtgaatgtaagaacgggccccctgttcatttatcataaaaaccggccttcacggtttctacataccgaaaaaacagatcggttggcgtgtatttttctccccggcagccaaaattgctgaacagcgcgtgtctctgcgccgtgctcacttccaattgcagccccattttcctttttgtccgattgacaatgttgccgggatttaaccctgccagccgatcattcttctctgtcagctcggcatcaaatcccgcttcacgcagcagatcacaaatcagtcttgctttttccagatccgcgcccccgacgagtgtatttgcctttttcagatcatgatacccgtgaaaagccaatgcgtaatgatgggcggtcactttttctaaagccagaggctcgtcaaagcgtgtgcttgtcaagtggagagaacggttatcgcaccgcttcgtcccttcaaataaataaattgagctttggtcagaaaatgcatgcaccagctcactgacacccggctcaatcctgccgccgtggggagcgaggacgatacatttacttccctctttttcttcataaataattctgtattccgattcagcagcggaaagggctgcgaaattgtcatatctatctttcatgtgtaacatgctctccttttccagtcagcaccagtttactctactcatctgggaatggaaacctttttatagtatgatttgatagaatacgtatcagggaggagatatcatggggttcatcaacggattgctgggcaatgcgtcgacaatatcgacggctgaagcaaaatcagaactggcccgtattttgctggaaggcgagaatgtcaatgccgcatttaagcttgtccgagatatcattgtctttacggataagcgtcttattcttgttgataaacagggactcacggggaagaaaacggagattcaatccattccgtacaagagcatttccagattcagcgtagaaaccgccggccgctttgaccttgattcagagctgaaaatttggatttcaggcgcggaacttcccgctgtctcaaagcagtttaaaaaagatgaaagcatttatgatattcaaaaggcccttgccgcagtttgtatgtaagaagaaacggaagcccggggagcttccgttttcttgattacagtttttcttcaattttcgccttcgttttcgggccgtaaattccgtctgccgttaatccgctgacggattgaaaacgttttacggcatttgccgttttcgggccgtaaacgccgtccgccccatgattttttgctcctttatcgggataaaaataaagtgcggataaagcgttttgcacttgttttacgtttgtccctttcgtcagcggtttcgtcactttgatcacaccggatggaagcggatatgaagacacagcctgactttttgaagaagaacccgtctgagcgagcttgatcacttgtccgactgtaatgtgattcggatcggtgatatggttgatgctttgcagcgattttacgctgacaccgtgcgatgcggcgatttccgataaggtgtcgccttttttcacatggtattcagacgcggaagaagaaatagaggcttttttcgccggcatacttccgcttaatttcttttcaatcttcgccttcacttcatcccagcggccttcagacaaaatgcggtgcgggcagtactttccgttccagtcctgatgctttctgattctgtcaatcccccagccccgttctttcaaaagctgcgccgcaaacgcaatcgccagttcttctgcggctctgtaccgttcgccgcctgacttgctgtaacagatttctatagcaatcgacttgcggtttccggtaccgttcgtgccgtctcccgaatgccaggcattccggtccaacggaattccctggatcacttctttgtcatcaaccgcaaaatgatagctcgttgattcgctgtttcccgtcatatagctgatttcattagcggcggatgcgtcgtttgccgtgttatgaatggtaatatactccggcgtcatcggattcggacattttaacgcatatttatcagccgatacgagccgttttttcacttcaatccccactcttcatctctccttatgcctttttcatcaataggtggcattcgtaggacagataacttgagcatatcgaccctgcattcggataaaattggaatggacacgcatgcaaaaaataagacccttccaaagaagggtctttatgttatgtttggttgcgtgcggcaatatggaatgtgccgtccgcttggttttccaaatggctttcatggccgatcacctgtgtaaagctgaacccgacagcaacaagcagcaatcctgacaacagtttagatttcatatagacaatctcctctctggatttgtttttgggcgtgcaccattttttcataaaacgtgagcgctttttcaggctgtccgtgtttcatgtaaaatttggcagcgtcatgcgccaattcttccacatacggatacaacatgtgttcttccagaaaatcaaacgtgtgcctgacggatgcgttatccatttccttgccgtataacgcatgcaaaaattggaacagattgacaaacaattcatcattgtattcgcgggcgatactgagcccgaggcgatattgcttctctgcttcggctgtagtgttctgtttataaagaacctgtgttaatgagtaaatagaatgcggaagattatcgaacttttctgacctgcaaatggaaacggatgtctcaaaatattcggctgctttagagaggtctcccattttttcgtaacagtttccgagattatataaggctgaactgataagacggggattgccttcttgttttgcaagatctaaagcaagttctaagtggggcaatgctctttctggatactgcatgtcatcataattccctgcaataacgaattcacattggattctgcggacgttgtacgtctcatacgattggtacgtttcaagggcttgaacggcataactcatggagacgtaggtttgtttcaggttgtaaaaaatctcggccattttaaaagcaaactcagctttctcgatgtcatcagaaacgagtgcaaggtttttttcagcccgtttgtaatacatcatggcgtttaggaacattttctgtttaaattcgtacattcctcgaaaaaaattaaagtagtaatcaagcagtcctgtcagtttatactggttgccttcaatgtcttccaataattctgaaaactcaggctgagaagggtcctcctttaagggcttgatgtaatccagcatgacgcggtgtctgaattccattaatgaataatacagcagcagatcctgatcttcttccatatcctcaatctctctctctacttcacgtttgacgcgctccgcctcaaggacgtgaaactgccggatatgggtataccattcattaattttgagcccgacaaaagaggacggaatagtctgcttcatcctcaataaatccccccttttggaatgaccgagatatgtcatattttatcataattgctagaaaaagaagaacgcaaaaagaccgcaattgtcgaatttcggatatccgcaacgatttatctccatcacaagcttattgcttgtttcttccgtgccgttgatatagcatatccttgcagcttttattctgtattaaatgggggttttcacatgacagcacaaaatcaattggtcagccactttctgtcacatcgaaacgtgacgattgagctggcggaaaaaatcagccgcgagcattacgactacaagccggcggagacatcaatgtccgctcaggaacttgtaaaacacatcgtttattcttttcttatgtttgcaaacgtcattaacgacggaaacgggtcagctatccagaacaaaccgaaagaagaagcggaaacagacctcgtcaaactggctgaagcatgtactgaaaaaacgacagacatcctgtcacagctgactgaagagcagctgaaccgcgaaattgacctgactgcctctttcggcagaaaaataaccggcgcggctctccttcagcttgccatggagcatgaaattcatcataaaggcaatcttttcgtgtatgtcagagaaatgggccacacggaacttccgttttatcagcaaaaatcataatccggccatcatccgccgatctgcgaaataacagcaggcaggcggattttttgttctgtataaaattttccgaaaatttaattgattaccgcctcttaatcatatataatctgataaaaatagtaggattattcaggaggcacacagatgactgtaagcattgtgtttatgggtttctttgtcggaacgctggtcggattgacgggtgtggggggagcggcgcttttgactcctttactgatcgttttggggatcaacccctcaatcgccgtcggcactgaccttttatataattccatcaccaaactgttcggtgtcgtttctcattggaagcagcgcaccgttcaatttaaacttgtcggctacttggcgctcgggagcattcccagcgcaacagccgccatcggtattcttcacttgtttcccgcttttcaccagcatcaggagcagattatcaaacaggcgctcggctacgtgctgacccttgtcgccatttccattatcgcccgcctttttttcgataaaaaactgcggccgaaccgctggcagcaaaaaacacttgaagaaaagcggacactcatgatactgatcggcgtcattttcggcttcatcgtcggcctgacatctattgggtccggctcattatttgcgatcgccatgttatacctgttcagaatgaaaacagcagaagtggtgggaacggatatcgcacatgcctttttgctcgtaactgttgccggtctgttaaacgcaagcttcggaagcgtcgattacctgcttgtattgaatctgttgatcggctctgtgccgggtgtgcttctcggcagcttcttttcgccgaaattctcaccgcgcccgctgcagtttgtgatggcggcgattattttaatcagcgggataaaattaatctaaaaaaagcgtcctttacaggatcgcttttttatttgggaaatcccctcaatccaaagccaatggggtgggaatttctttattaactaaccttaaaagtgcatataattgtccggttttccctaacatcataccaagtcccgaatgatcatttcttattccattttgccagccatttttcaacagggtctctttaaaatggttaacccatatattaattgtattctcaatctcttgcttgcgatttttaaagagagataattccttaatagcgtgaagtacatctatattccccatcgttccatggcataatgagtagccctgacgatgggaatttccattcagcaatgtgtcatctaaagactcattaatatacccaacgtgaatgcgcccgtctacattctcgtatatcctgcttcttccaagaagaataccgcaagacccgtgacaccacattgcggaagaataatccgactcattttttctgttatccctccatttttttattttagtatcaaaaaatttatcttcgtatttgagagctgattcaatcagtctaagtacttctccagatgcctcaatatgcgcataatattcagatagtgcataacaaatcccagtaataccgtgagaaaaccctgctaaaacaacattctcatccgcgtcggatttccaatatgcttcatttctattttgaatcattcttttgcatatttctttacaaactgcccttgccgtatcttccattaattcagtccgataatacctgccaagctgaatcacaacctttaatatacctgcgagtccgcctataaaatcggtatgtgttatttgagcggtttcctgacgaagtttctctaagtatgctttacacatactattcacttcattttccgaataaagtccggtacctctcattttattgacaaaatagatataagaacttgacccgtaaaaagcagagaaatttgttttataaatactatgctcatatatttgattaattgaattcactattttacgaagaatcgatttgactttttcatcattataaataaaatcataagctgaaaaataaagccccactccagctaacccatcgtacagcccaaaactcaacggtcctacggataaggtgccattgggagccgagactattgatacccattgaagatatttctccgattcgattgcttgttttaatatacaatctgtttctatttgaatcagctctttgatttgtatgtcattttttaaatatccaggtacaaaatcatcaatttgatttttataaataatatccaaattagccgccgtggagcttaaggccatatttatcaagctcacttgctgatgcatgtcttcttccgacatattcgctaaacgagttaaaacttcttgtttagcgctttgtttcataatccctgtatccaccacatgtattgaatttgaataaacccttttttcactaataggagcattaaaatagggtatatcaccgatcatcatatccttgatctcaaatggactgatggaatcaaatacttcatattttgtataagcatccttaataaaagataaaacccttatcctttctccataatcttttaaatacataggatggaggagggtttcaagaaatgaagcgtaaacatatgtaggtctgacaataattctaataggggcataatttaattcgcttataaggttccgtatatataaatcttctttcaaaatcaagaatattcttttgaagccttcaataaattctctttcaaattcaaaacattctgctactttatttttgtaaacaggaagattccttccccttttgaagagatattgtttctttcttatagaaattttatctgtttttatatgaagcacttcttctttttcacctttttgattttctgtgtttatcaagcctcctatattagtcagcccattatcttccggaaaactcatatagttaaaaagtgcagattttaatattgttttatttacctgtgctgatgccattaaattaacattttccttgttctcctcagaaaaaaagaggctgctttgaaacagagtctcaagatcaaccaacactggtttatcacgacatgctatgatattttcaaaatgaaaatctgacccttgaaaagcataaataaatcctaaatgcattccaaattggtaataataatttcttacctgttcaatattatcgcacggttcagactgtacatactcttgccacccgtactcaccttgatccaaggataaaggtgtttttaaattagtttgataatactgattgacataatcaatgaccttttcataaaaaacatcaatttcaagtgaacggggtttataaacgagtttgttattctcaaattcaataataacaacacttttaccgccattatgaacatcccctgcattcatattaacctttctcatttttccgaacgaaaagttgaatttttgttggatttttttatagtcattaacccaatgtttaataatagatatagtgaagcgtataaaatcagaggtggatctggagattaaatcttgcaatacaggataattattgagtatttcttcaacaaatgcggagtttttcagcctttctgagaatatatcataatttttagattcatttttttcatcaaactcgtcaaaagtttgatgaaactcatggataagtgttttccccgccaaatagtatatttttttcttataattaattaatatcgattcaacaagacatcccttatccaacagactttcggatggtattctatctatttctttaacaatctgagctttaaaaatacttatataatactgcgcaaaaccttcgaaataatcctcttctttaaaaatattcaacatagagttttcataaacatagttagccgaattctgtgttttgttcacaattatcacttccttatatattcttgactgtctttgacaaaaaagaaaaagaatatgtacgcatatacatattctttttcggatatgtttaatcgttacatggactgacaatggacgcacactttgtcgtcggacagcctgctaaagagattggtattgtgatggttgtcggcgttacggtcatcggggttgcatctgaaccccctgcaaggttttttaattcttcttcagtcattggagtcagtgcttgaaaatcttttttcatgttaattcctcctattgtttgagttttttataaatttcagtcgttacatggactgacaatagacgcacatttagttgtcggacagcctgctaaagagattggtattgtgatggttgtcggtgttacagtcattggagttgcctccgagcccccgccaattcttttaattcttcctcagtcattagttccaatgctaaaaattcttttttcattaaaaatccccccgattgttttttatacttgcctttgcggacatgcgcagcctactgtgatagttggacaaacatgatttgttattggaattgttgttattgatactgagttttgccctccaataagctctcttaattcttgctctgatgtttcatacaacgcgctgaagttctctttcatattccatatttcacctcctttcaagttaataagtctgctggagctgtgattcatatttggtcttaatcgtctttaagtttccattttcaatctcgtagacagattcggagaattcgagccattcggttctatgagtaatagaaattacagtgatatcctttttgtaaatgttatttaatatatttaattctgtatccttatccaaattgcttgttccttcatctataaatagaattcgcggatttttcgctaatactctggctattgagattctctgccgctgtccacctgataaggtaataccattttctccaatcatggtatgatacccataggcatttttataatatcctcatgaatacatgcttcttttgcagcttgtacaacttcttccattgttattttttcattgaaatattttatattatttataatagtgtcattaaacagattgacatcttgaacaatataacctaacgtttctctcagcttaaccatattaacgtcctcgattttgaattcaccgtagcaaatttctcctgctgttttttgataaaggccggcaatgattttaatcaaagtagactttccgcttccagtttttccaattaatgtgattttttctctcggccggatcattaaatttatattattcaaaatataatcgtttccgttgtagctgaaatcaatatttttcaagctgatattatgagcggccgggttaaatagttcaatgcttttatcatttacttcctcatctttttcatccagtacagcctcaaccctgtctaccatttcttcaactaatttaatagactctaaactgccgataattgatcccagcggagacataaaccgtccggcaatgttagaaaaagcaattactgcgcctagcgtaaggcctatagatactgctgaccaagtacccacaattaaaataagtaatggcaaagatagattgattgcattggagaccgcacccagtaaagatgaataattcattcttttagagaaataatctaactgatgattaaagttataatttaattggctctcaatattcctggtttctcctattgtttttataaatgtcattgatcttaagatttcgattagctggctctgaaaattggattgactatttacttcctgttttgtgaacatttcaattttcggaagcaaaattttagtactcatcacctgtatagctgctcccaataaaactataaaagataatatcggagaataaacaaacatgactatgaaaaatacaaatataagactgatatctaatatcaaagtagacgctaacctggaaatgacttcacgaattacagcaatgttatggattctagttgaaatatccccggcagtattcgcctcaaaaaactttaatggaagactaaatattttatgaattattttatcagtcatactcttattaatttttaattgcagtttgataataaatttcattctgattaaggacagactaaagaataatacgattgaaacaattacaatcatgaaaagcattggtatgggaagaattttctcatttccgtcaataaatgaatcaataatatattgagtcaaaaaaggggtcattaagtttaatgcttgaaaaataaaagtgaaacttataataacccccaacaattttttatctttcaaaagatattttccgatctttctaaatgaagacacatcttttaacgacgaagcagtcttatcctttctctcaagttcgttctttctgattaacataatagaaatgccattatagaaggttttgaactcttctaatgtgattgtcagtctgccagacgaagggtctataattttaacgttatctgtgccaaatgcgtcgacaactacaaaatgattatgattccaatgaacaattagcggatggtttttatttaactctttaagctgcgttatattgtctgtgcggaatgctttgaaatcataatcgaatgtttcagaaatccttttcatttctattaaatcagtgccgtctcttccgataatttctttatttaatttcaatttgttaggattgatttttattccctcagccctgctcaaaaccatggctaaacaagtaataccgcaatcaaattgatttctttgaagaataaccggaagctttctttttctaattttcataaatgtctcctaatgtatctacacgtcctatttcaagattgagaatattcggcaattctgcgtctgctgcatacagcattccatatacgatccccgctaaaccaagcattaaattaggtgtttcaacatcccttccaactccgcattggtagaaacctatatttttgtcttgtacactctccaaaatcaagttttttcctatatttacaaattgactttcaccagtcttttttccatattcgatcagtattaaagcatttcccatgtctccgtgacaaagactttgctctcggccaaaaccgtcataaaaaatgttagaaacggttttattcagatcttttttggccacttcggcaatatcagggtgttttgaatctttcaattctaatctgcttaatagaattccaggggatccatggcaccatgcagatgttgcagcttcatttaccgtttttctcagatcaagccagttaccgtttactttttttgaattttcaaaagcaagtccttttcggatgtacatacttatatcttgatgttttgaatgtttctcgagtaattgaagggcatatatcattccagcgtttccatgggaaaaacccgttaacggcttatttgcaataccttcccaagtgacaaaatcctcatcaagaaagatcgcttgtttcattaaaaatgaaccgcattgttcagccaatgataaaaagaatgtatcattctctatttcaaacgaacgtatcattacaataagagccctgctgtgcccccgattatatccaattctttatcataaggaagcaaggacggaataagctgagcgatttgttttgcattctgtttatatttttcgcgtttagtatacatatagaaattcattaaagtatatactattgaagacactccggaaaaagcacctacagacatactgctgtcttcgtccggtttcacctcaatatcaataaaacgagagatgacatctttcataattttttcggcaatgtccagatacttttcttttttcgtgacgcgccataaagccaggtaggtgaaagccatcccggaaagcccgtcgtaaaaggtatcacccataacggataagttccattgaatttcatcaactccaataggagtagcgttaagccaagaatacgaacttcctttatctgtgtgtgctttgtaagattgattataaatataagcggccaattcctctgctttttctattaagatactttcttggttactactgaaaacatttacatattgtcctggttcttttgttataaattctttcaaaacaatttgccgatcatcctccgaagcaagcattgacagttcgataacatagagctgaaactttaaatcgtcttttgataaatttgaaattctttcttttacactttgagctggtgtttccggaaagtaattttcaattttcttattttttgagcttagtaagtctttctcattcaatttcactttgaaataaggtatatcattattaattaaatcgttgaactcatatttaacaatagattgatattcatcttcttgctttggtctctcccatatttttgataagaaaatttctctatcaatagagttgtgtaaaaatctaggatgaaaacttaattctaataaagcagaatactttattgtcggttttgatataaaccgaacatatatcttgttttcgctcttttctattatgcgaatcagctccgaagcatgttttaatatagtcatatatgcttttgaaaaaccttgcttcagttcttcgacataatcttttgcatatacaaatttattctcaagcatagggtgattattagctgtatcaatttcgacatagtctcgtttgacagacatttctgctgtctttaaattgataagctgaggaactttaatgatcgactttgctttccctttccgacctattccgctgatgtcggctttgcccgcaaagaaaaaaggaagcagccctaatgctctgacagattcatgaagctgcgtttcagctttttcataagcgtccatcccatcctttttttctggtatgcaggatgaaataaggattccaaatcaatgagaactggatagctgccgttggcaatgagattttccgaatgaaaatcaacagctttcaatgcatataacaaaccgatttgagctcctgtacgctgataaaagttttgaacatcttttaaacaattgcatgctttaaaagatataaattcagtccatccatatccgtctctgctaaggacattcggagtgctcaattttatatcatgatctctaattttctcattcaaaaattcaattatctttttatataatagatcaatttctaaacttctcggcttataaataagtttaccttcatttaatgttattttagtaacctttctcccatcagaatgagaatcacccatccctacttcaatgtcccttattttgacttgttctgaaaaaccaaataaagagagcagttcaggcttgtccttttcaaaacgggagataaattccagtatgaattttttgaattttctcagttcatttccaatcgctcttaataagactggatatcgttggaaaaagttttcaagatactcctgactgcacaaaagagttttattataatcaccatatttttctttaggagtctcccctgccaaaaaacctttttcccgattcatattcatatccaatacaagtgttctataggatacttttaaaatgattttttctaattgatttgaaatactatgatgaaaaagagccggttgttccagcagatagtcataagaaggaaactttgattttttaagtagatcattgaagtaagaggacacttttaacgcaaaaacgtgaaacatgatttcttcatttacgtcttcttttttaatagcttggtgagcgatccctttttttaggttttcgaaaacatgaactgtaaaagcggatttatgtagtggggtttgatataagcttttcactttatcaattgattgaatggataacacattataaatgctttcctgggccatttgaatatcattcttatagattagttctaagtttcgatcaaacagtttctcattttcatcaaattgagagacagcagcttttttttctttacttaatagaatattagttagcgaattcatttaatattcatctcctttaaaaaaagagggagacagctggatctcccagagcattggaaatctattttcttatttcgggttgttttaacaccagcaagtgtgagtaggacaaagaccgcattcccaagttaacgtacaaagcttaccatcatttccttgagaaatccctcgctgttctgcgcctcctcctccgctgaattcacttaaagaaatttcctcaagttcttctcttaaatcaccggcaaaacgatacattttctcattcattaatattcctccccttgatttttgaaatatattggattttgatccatatatttctataaacctatgataaacgatcttttacctataggcaccgaaaagtcatattcggaaaagcgctttttttttgcgcgtttccgaagtataggttataaagaaaatcgggattaactgttccgttaatcccgattcatttactcatatatagttttcatagaaattaatgaatatcgatttgctttgatcagtgcctctgttctggattttactccgagcttgttgtacacaccagtaagaatgtattcaaccgctctttgactgatcaacagctttgctgataattcccggtttgtcattccctccgctacgcccgctaagatatcttgttctctttcatttaaagtaatatctcttattctatcttcaagcttatcaatgttgaacgtatttgcttctgttcttcttaattgtttaaagagatgagtaggaataatggtatctccctcaatgacactttcaattacttttatcatatgttcttctgttgatgacttacttatgaacccggaaacaccaacttcaaccaaaagattgaaatgcacagagatatcaaaaccagtataaattataattttttgatcggggctctctctaagaatcatttttgacaattccattccatttaactccggcatatataaatcaagtaaaattaagtcatactcataatgcttaaggtgattaagtacttctttacagcaagacaatattgttactcccattttattgcttttttcaagaatggcttttgtcccttgagcaacaccaatatgatcatcaattaatagaatctttatcatgtcagcgctccctattcatttttcgtacttatttcaaaccttaacagcaatccttcatttacgcttgaagatatattatgaataccattcatacaatttatccgctcttttatccctgtcagcccaaaactgtttgtttttgaatttactttattccaatcaatgccgattccattatcttcgtaaacaaacataagacttgtttttttttgaatcatcgtcaaaacaatataactggcttttgaatgttttacagcattagtaagcagttcttgaacaatccggtaaatgtttattgtgatatcttctgtaaaaatagaatcatcttttacatctacaaagaattcaatatcaagctgatagttgcttttatgtttatcaatcaggacttgaatgcttcgaagaagtcccatctccattaaaaaaggtggtcttaaatcaaaacatttttctcttatatactggatattgtccagcaaaatttctcttatgtaataaatatccttgtatttctcaacatgatactctaattctctgcatacaaatatcagctcttgaatgatagagtcatgaatatcctgtgcaagcttggttctctctatttctgaaattgaaaataaaaccttagaaagtacagccgacttacatttatgttgatcgtctatgataatttcatcaatttttttttgaatcaataatttgttctgaagtgcagatgctgtgcagaatgccagcattcgcagccaatctgcctcgttttcacgaatctttatagggtgtccttcatgtgataaatgaataaaaacaaatgtatcacacttctccccgataaacagaattgatccgctggcggtttcacgtatttctcctatcttaaaatttgaaatgtttatgttaggaacttgaatgtttttttctctcaattttaatgtttttttgtcatagtttataagagcaatctgctttcctgagagcacactctgtatttcattggttagttcttttatcaattgatctgcatcggatcccttttgacataattctgaaaaacggaacaggctgcgaagatatgtcttatttctgtcatcataggtaaagcataaacaactactgccgaatatacttagaacaaaaaatagactatactgtttaaactgtaattggctgtctgttataagcaaaagcataaaaaacaataataaggagaaaacaaaagcccttgcaaactgctcaatattaagcttcacccaattatctttcatttgtatccaagccccttactaaggaaaataagggaatccctttgaatccccttaaaatgaaaaagttactttacacttattaaaatataaacagcaaaggcaacaatgtataccagaaatgatccagtcataaattttacaggttttcttgaaaagtttagtacgcctcttaatccgtcattcaaaatcattccgaaaaaggtaaccagtgtaactcctaaagcgagcattgaaatcacaaaaataacttgctccatgtatactcatcctccatttacattctgttttttttcgaatatacgtataatcctgataaggataccaaaacatacagccccataatcagtaatccccaaactaaaagaattgaattggtatatcccatatcactttcagaaatttgaatactgaaacgataaataaaagaaaaaggaaagactattgagacatcacttgctaacagtatcgtcattattaaaaaggaagctacaccggttatcatgacaaccactagatttttacttaagaaagcaattaaagctgcaatcggaatggttagcaggctcaaagtagtagaagtaaaagatgtcgctattaatcttaataagtcgcttgctgagatatcttcccgaaaaaagaaaaacaaggtggataagtgaataatatgattaacagctgagattaaaaacaaaaatagaaaagctgcagctagctttgataatatcaatttgaatttatgatacggatatgacatccaattcaacattgtcctgtttttaaattctaaataaaaataaaaacctgaaaaaataaaaataatagtcggaaataggatcgaatactgattaaaaacaaacatataaaatttgttccaatctgtattttcgttcatagtcaaaagaccgattccgtttatgagaaatggcaaaaagcttagaaagaaaataacataaattgatttcagtcttttaagtttcagaaactcgttacgcactaacagactcatgacctttctcctttgccagcagttttaaataaagatcttccaaagatagcttaaatccgtcaatagacgccttgttaaatccccaagaatttaatttctctttcatttccgacggatgaattattgaaataaactcgaattgctgtttattctttgaaataacatgatccgcaaatttctcaatatccgcccaattaatacccgcttcagctggaattttgtacaaataaagatgttgcgtatttttcataaaggctgactcgaaaataatctgccccttattcataataagcaattcatcggccatgagattaatctcacttaaaaggtgacttgaaataacgactgtggttccatttttcattacctcttggatcaacatttcacgtacttctttaataccatatggatctaaaccgttcgtcggctcatccagcaaaagcaatgcaggagcatgcgcaactgctctggcaattcccagcctctgtttcattcctaatgaagtttgcgaaaacagcttatctttatgttcaaaaagtccaacctttcctaaaatctcatttatttcttcatcagaagctgatttttttaaatagttaagatgtaatttaatattctcaaaaagattcaaattttcataaaagccaggaaattctataatgcttcctatagactgaatcacatcattatttggatttccatataagtcatccccctcaaaaatcacttcacctgaagttggaggaaatatccctaacagaactttaagcaatgtcgtttttcctgcaccgttgggacctaataaaccatatattttacctttttccaatgttaaatttatatcatgtaaaatttctttcttttttatagaaacattgatacccttggatattaaagctggatcagcctttcccacttttcatcattcctctccgtcttgttctgtttataatataaacttacgaggttaaaaagaagatatagtcaaggttaatttacgtttaaatttctcaatataaaaaatacgtgaagcctctacggcttcacgtattcattgctgtttggataaataataaaaaccgttccgttttgattgctctttattttatgttcaagccccatttgtttaagcatcatattaatgatcgataagccgatcccggcgccttttctttcagatttataattcattcccgggcccctatcctcaattatgattacgggtttgttttcaattagctttgtctgtacggaaacgtattttcctgaatgagcatggcgcaaaacattttgaaaaatgttatcaagaattctcttcagccaagtctcgtctatttcccatacgatgttttccttcagatcaatatctattgtgaagtgctctttctcaaaaattggataccaagctgttaacgaagaacgtattatctttaatatgtcacaactctttttatgaagcggcaatttacctgcggcaagaagagaaaatgatgacaaattgtcaatcagttcgcccataaacgttattttatcgtttatgatgcctaaagaatgctttccattttcactgcttatttcattcttcaacgtaaatgtatgccctcttataaccgtaagaggggtccttaaatcatgagataaatcagcaatcaagttttttcggatttcgccttcttcacgctctttttgtctgctgttccttagttcctcaaccatctggttgaatgaatattccacttgacccagttcatccttctgtttaactgttacaaattccggtatgccgtcattatcttgttttttcatatgattccccaaagaaattaaccttttttgtattttcgcaaaaaacatccatgaattaatcacaaaaagtgaacagacaaaaatcaaggcgataaaccatatataggaatacttggccctcataacctcccattgagatcctataattgagcgcggagtttctaaaaatgcatatccgctgtcttcactcccatttacataagcactcagcaataaatatttcttttggttttgttccatcaatttaatcaattcgctaacgtgaataacctcaccctttttggccaaccgttctgagttcgaaaacatcacctttcccttatcatttatccatacaatatcagagtgtttatattgcttcatgtgcgggaaagcagacgtaatttcccgattggatttccctgaaaaaccttccacatcagacttccaatcactttccaacttgtttggttcatagtgtacttgcccctggtgatcaatcaagtatgttaatgtgacatagtaaagaaaattcacacctaaaaaggctatcggaaaaaacaaaattgaggcaacgatattaataaggtattttgttgataatttcattgtttaatcctgtatccaatccctctgatcgtttcaagaatttccggctcatttggattgatctcgattttttgccgtaaatgcctgatatgtaccatcaacgtcttatccccttcgatataaggctgctcccaaatattttcataaatttgttcctttgttaatatttgattgggatgtctaagcaaaagcaaaaaaatccttaactgcttatcagttaaaaatatttcctcatgactttgatgatttaaaattcttttttctttcaagtggacacttaagtgttttagcttcaattcatgaatggcagtcttgtcaaatcttcttaataatacttcgattcgagcggccagttcatcgggatgaaagggttttgtcacgtaatcatccgcaaatcctaagcctttcagtttatcttccagacccgttctcgctgttaaaagcaagagcgggatctgcggatgtgtttttttcatcctttgaccgattgtaaatccatctaaaccgggcatcattatatcaagcacgatcagatcagccttttctatatatgtttcgtaattataggaagaagtgagccatataatcatatagccccgatcttctaaatcatcctttacaaattggccaatttcttggtcatcttcaatgtataaaatgttattcattaggaccccctctgaaatatgtgactaaaaaccaatcttccataataattatatatattataaaaatctcctttatgtaaggcaccattccattattatagctcatagatattcacaattcatcaaggggcaaaacgataagtgaatgcgaaaaggcggtctgttgtcagatcgccttttcccttataacgtcacaccggacttaaagattgcaagctcccgaaaatcgtttttttcgttattgacgtattctccgcttgcaactttaataatgtattgaataaaatctctcacaatgtgatcttctgttgtttggtcttccgccaatctgcccgcattgtaatcaatccaatgaggttttgattgaaataaatcggtatttgttgatactttcacagtcgggacaaatgtgccgaacggcgtgcctcttccggttgtaaacaacacgatgtgacagcccgccgcagcgagcgctgaagaagcgattaaatcattgccgggcgcactgagcagtgtcaatccctttgttttcagtgtttcaccgtatgtcagcacatcagaaaccggtgcaagaccggctttttgggtgcagccgagcgacttgtcttcgagcgttgaaatgccgccttccttattccctggtgacgggttttcataaatcggctgctcgtgcttcataaaatattgcttgaaatcattgatcaatcggactgttttatgaaacacttcttcactcaccgcacgctgcatgagaatcgtctcagcgccgaacatctcaggcacctccgttaagaccgtactccctccctgtgcaatcaagtaatctgaaaatcttcctaataaagggtttgcggtgatgccggaaaaaccgtccgacccgccgcatttcaatccgatgctcaattctgacaggggaatctcctcacgtttatctccctttgccgcaaggtgtatctctttaagaagcgctgtccccgcttcaatttcatctgtgacagcctgtgattcgagaaatttcacccgatctccgttcacttcagaaagcgtttccttaattgccgccagctcattattttcacagcctagccctaaaaccagcacaccgcccgcatttggatggcgaatggcgttaatcagcatttgtttcgtattctcatgatcatcgccaagctgggagcagccgtattggtgctttaaaaccagcacattgtcaaagggggcaatgtctttcgcctcttttacgaagcgctgcaggattttctcagcgacgccgtttacgcagccgactgtaggcacgatccacagttcattccggacgccggatgtaccgttttctcttttgtagcctttaaatgtccggttctcatttgtaaaaggattgtcctcgaagcgcggtgaatacgtgtattcttgcacatcggataaattcgtttgcagattatgggtatgaatatgctcgccggccgaaatccgccttgtcgcacgcccgattgaaaaaccgtatttaatgatgctgccgttttcttcaatggtttgcagcgcgattttatgcccccgctttacagggtccttcacttcaatcgccagtccgtctgtatacagccgctcccctttgttaaaatggcgcatagcgagaagcacgttatcgtttttatggatttttatgacctctttcatttcacttccccccttattgccgcagcattcatgtaacgcatgcttcatcccccgcttatgaatgacagagagaaaaaaagccgttcgttcagtcagccccggaagatggttcagattctttccccacaatcgctcttctcctaatatagaaaatgccgcttgaaacatatcatctttgcaacgggaccgcgccatttgaaaacggttcagaacctcctcgccatctgccggtttgttcagcccgttccagtatgaatagatcatggcgctgaatgaaaataccagcctctcaggaagccggccctcctgttcgatataagccttcagcgtcggcaggtttcttgttttgaatttcgcggcggcgttaagggtgatgctttgcagataatgttggatataagggtttttaaaccggtgtaacacatctgccgcatactgggtgacaccctccatttgcagcacgggaaggatttcttcattgatcagctcttcgatgaatctgcccgtcacctcgtgctcagccgcttcccggacggttagcagtccgtataataaagccactggcgccaatgccgtatgagcgccgtttaagattctcaccttttttgtcctgtaaggcgtaaggtcagacgtgatcagtgcgttcagcccggcatcagcaaaaggaagctcattctgaagctgttccggcccttctatcacccacaaataataatgctcaccgaccacaagcagacggtcttcgtatccgagaaaatcggtaagttcttccgcggtatcaacaggaaatcccggaacaatccgatccacgagggtattgcagaagatgttcgcatcatgaatccattgagtaaaatcaggctccagctcccacagcccggcatattgaagcacggcagccttcagtttccgtccgttttcttcgaccagttcacatggaagcacaatgcaccctttctcggcgtcacccgcaaatgccttatagcggaaataaaggaacgccgctaatttcccggggaatgttttttgaggcctatcctcaagccggtcgcctttctcaaacgtgattcccgcttctgtcgtattggagatgataaaacgaagatcctcttgtgctgccagccgtttaaaggaatcatagtcagaaaaaagatcaatgccgcggctgatggatttgacgatcgtgtgttcttcagccggttttccgtcctttatcccccgcaaaaaaagcgtaaacaaaccgtcctgttcgtttaaacgttttattttctcagagcctctcggctgtacggcgacaacgcttccgttaaaatccgtcaattgattcaattgatcgatctgccagtcagcgaaggcccgcaaaaagttgccttcgccgaactgaaggactttttcaggatattgaatgtattttccgcacatctttttattcagctgccgcaagctgtccgcctccttatatttatgcacacgttaacattctcccgtacaaaaacccggataatcagacgggccgttatgtgagttttttaattgaatctcttatcatcacctcggtgttttcgtatattttttccgccgccgtatccgggtcggtgataagcgccaaaattttctctgcgccgagtatgctgattttttcaaccgggcgttttactgtcgaaagcctcggcgtcatgtattgggaaatgccgatgtcatcaaacccgataacggaaatatcttccggaacgttcaggcctttggcgaaaatggtattcatcgccccgatcgccatatcatcgtttgaacaaaaaacagccgtaggcggtgattgaagcgccaaaagtttttccatcgcctgactgccgctttccatatcatagcggccttttacactgtattcatgcttaatcgggatagaatgatcaattaaagatgtcaaatagccttctttccgctgagaagctgacctgaatccttcctttccctcaatgatcgcgatatctctgtgtccgtttgcgatcaggcagtcgaccgcctgtctggagccttctttatcgtttgacaggatattcgtgatgctccggtcatcaatgtcccggttcagcacgacgagcgggatgtttttctcgcggatatgataaataaatgaattatcactgtcgctttggctcattaaaatgattccgtcatatctcatgggcgtaatggtttcaaagcttttcagatcgtcaatcgcgcggacgaacaaattgtattcctcactgattgtgcggtttacacctttgatggtatcggaaaaaaagctgtgtgaggttccgtttgtgatgcttgtaaaaaacagtccgatcgtatgggacttttgcatggcaaggctttttgcatttacattcggtgtgtaattcagctgtgaagcgagctctaatattttctgttttgtatgctctttaatgtaggggctgccgttaagtgcccgggatacggttgtgtgggatacgttggcgagttttgcgatatcttttatggttaccatcgtttttcctttctttctgtatgctgtcatttatttctattgtaccattaacggacagtccataaaatcactaaagttgaggttttgcatgatgtaagtcctgaacgagctcgtcatgctgccggtccgtcagtttatacattaaaccgataatcagcatggcgcacgctaaagcgaaagccgggtacagcagcagaagccctttaatcccgattaacgtgccttttgtctgagacgcattcgggatatagccgataacgctcagcccgatgcctgaaagaaaacctgataaagattgggcgagttttctggagaagttgaaaagcgaatatgtcgtcgcctccttccgttcacccgtcttccactctccgtaatcaataatgtccgacacaagcgcccacgtaatgccgtttggtatactgatcccgataaaagcaatgctcgctaacgccgtaaagatatatacatttgacgggagacagaaattcagcgcatcagccgcggcgctgacggcaaaaccgatcatcaccgtttgcttttttccgaagcgtttgacgagtttcggcataaacaacacacctaaaaatgaagagccgatgatgataaaactcatgtaggacatcagctccgcattgttgagattgtattgggcgaagtaaacaagcatagcggatttaatgttgtatgccgatattgagaaaatcgtcatgaaaacgacagtcagaagcggtttgttgccgataaagcatttgaaaaccgacatgacggacagcttttctttcggcgcttcacggacgataattctttctttgcagtttcggtagcagatcataaatcccgcgattccgattacggccatcattcccatgactgccgggtagccgatgtgaacgttatcaaaatgaacgagaatcgggatgacgatgacacttgtaatgagcagcgcgccgagagagccgatctggcggaatgcggaaagcgccgttctgtcctccgcatcctgtgtaatggctgcaccgagggagccgtacggaatattgacgaaagaataagcgaccccccacagcatgtaagaagcataggcgtacacaagcttccaggtgacactcacgtccggtgacacaaaaatcaatacggtcatgaccgcaagaataatacttccgaataataagtacggcctgaatttcccccggggtccgatcttttttctgtagtcaatggccgagccgacaatcggatcagtcaaagccgcaaacagcttgctgaccaaaaaaatactgccggcgaacgctgccggaatgcctgcgacatctgtgaaaaacttcagcaaatagatctgcccgagatcaaacataaatccgttcccaaaatctccgaaaccataggatactttttctttcagactcagcttatgctccttcacttttgcggcaggtgctgtcacgacaggcacattactcataggccacctctttcattccattttttaaaagcggaaatattcctcagcattccggtaacaaattccctcgacaatcctccctaaaagctccatatcgcagggcgcttcgccttgttccgcccagccgccgatcagcgtgcagacaagccgcctgaagtattcatggcggggataggacaggaaacttcttgaatccgtcagcatcccgataaaccggctgaacaggcctgtgtttgataacgctttcatttgttgaagcattccatctttcgtgtcattgaaccaccaggctgtgccgaattgaattttccccggtgttttcccatcctgaaagctgttgatcatgctggcgataatatagttgtcattcggattcagagaatacaaaatcgttttaggcaattgccactttttttcggcggaatctaacagccgggcaagcggttttgcgatacattcatcattaatcgagtcatatcccgtatcaggaccgaggctgctgaacttatttgtattggtatttcttaacgcgttaatatggaactgcatcgcccagtccagttcggcgtaaagaccgcaaagatattgcagcgtccgtgttttgaatttcttttcatcttcaaaagacacatgctctccgcttaatccggcggcaaaaatccgggccgcttcctcttcggtcgtctcggcataaaccatttgatctaatgcgtgatccgacactcttcccccggcattgtgaaaaaagcggacgcgggattccaacgcatccaaatacgattggtaggtggtgacagccattccggaagcgctctccagcgaccggacccaatcggcaaaacccgggctgctgatgtccagacctttgtcaggccgaaatccgggcagcacttgaaccggaaaatcactttctttcaacatttcatggtatgtcagcgcatcggcaggatcatcggttgtgcaaatgactttgacatttgatttcagaatgagatcccttgcgccaaacccgtctccctgcaggagctcattcgtatttttccaaattgccgcggccgttttttcattcaatacgtcataaatgccgaaccagcgctgcagctctaaatgcgtccagctgtacagcggattgcctatcgccatcggcaccgtttttgcccaggcgaaaaacttctcttcatctgaagcgtttccggtaatgcagcgctcttcaatgccgttggccctcatgatccgccacttgtagtgatcaccgtaaagccatgcctccgtaatggttgtgaaggttttattttcatagatttcctttgggcttaagtgacagtgataatcaatgatcggcatgttttcagcgtattcccggtacagcattacggccgttttactatccagtaaaaagtcatcacccataaaagctttcacactctcatcctccctcttaaaaaatgttaacgttaacaaaatggttcttttttattttagcttcctctttctcacatatcaatcatttttattttatttttcagaaaattgtatctattaacatttttatgcaaaaaaaagacattgccgagaaaagtccggcaatgtcttctgtatgatcttaaggattagtaagcgaggctgaataatcctttgatatgtgttaaataacgtacgttacttgcttctttcattaaagatgccggaaggcctttcagcggagtagagttcgctccgatgatggcaaccgcgtctttacgtccgaggcttgcaagcgtaccagagtttacaggcttgaatgtttcaagcgtttttccttctaagtaagcgaacaggttgtaaccgacaagttcacccatctgccaagcgatttgcgctgtcggcgggtacggacggccgtccggcgcaaagtatacagcgctgtctccgacaacgaatacatcttcgtgagaagtagattgtaagaaatcgttaaccgtcgcacggccgcggttcacttcaaggccggattcgccgactaacgggttgccttgtacgccgcctgtccatacaaatgtgttggcaacgacttttgaaccgtctttcagatcaataacgtttccttcaacatttgtaacaggaagacctgttaagaactcaacgccgcgtttttcaagactttttgtcgcgcgttcgataaggtcatcaggaagaacaggaagaattttcggacctgcttctactaatttcagtttgatttctttcgggtctacgccgtattttttcgtaaggttcggcatgatgtcagcaagctcaccgacaagctcgacgcctgttaagccgccgccgccgataaggatcgttgcatcagcttcgtttttcgttttagagtattcacgcacacggtcttccacgtgtttgtatactttgttggcatcagcagcagatttcagcaccatgctgttttcttcgagtccaggaatgccgaaataagccgtaacagaaccaagtccgacaacaagcgcgtcataagtcagcttagaaccgtcagaaagggcaacttctttcttatcaactgagaaagaattgacttctgcgattttaatgtcaacgtcttttcctttcagaagtttttccagcggcatagcaacagcctgttcagacacgttgccggctgcaaggcggtgcagttccgtaatgatttggtgagtcgggtatttgttcacaacggttacgcgtgcttcatctttactgtaatgtttgcgaacggttaaagcagaaagaactccgccgtaaccagcgcctaaaatgacaatatgttttgacatcgtatatcctccgtcctttatatcaatttgaatctgagattatttttgtttttcgttcatgatttcaagatagctgttagcaaaacggaacagcttttgagcttgaggatctttcagcatgcgcagcaggccgaaaagtccgatcgtttcattgcttgcatccgcgcggtcttttgcttcgatggcagtagccgcaacttctttcgctgtttctttcaccggctcaagaatttctgtaagcgcacccactgtatcgctcttcaatacttcgtctgtcgctacagactgtgcaaaatcataagacttcgttaaaatatttactaactcagtcagttttggaagctgatccactaaaacagtcagtgattcttgaacttcaggttttagcagctgatcaataagatcgcgttggccttggctgacagatgcatttgtttgatcgattgtttctggcatatccgattctcctttactataagcagtatgctgattttttttggaaagggtagcctttcccccttcatgcagaaaagcatgaaaaagcaagattgtgaattcatgcacaatcatttacaaaaataaatgtttactacccagtttttcactttgccatatccagtattatttttatatcaacaaaaacaattgaataagtcaaaatttctttttcctctctgaaaatagcaaacataaaaaaccccaatttgatttactcttatataataacactttttgaacaaaatttgaacgtgaattgtttcgtttatgaaattatttatatggcgggggtgtaataacgtttcttttaggctatttttttacagaccgtccgcttttcccctgtcatttttcccacaattctaaaagcgggcccgattttcccgtaaaggggtcacattccgggagcgggacacggctgatttcttctgaagttctatcatttttctccgtttttgtatcgtactgccggccgcccggataagccccgatcacggtaaaatcagaactgcccgacagttttttatgtccggtgcctgccggaatgaccgctgcgtctcccgtttgaagaacggcgtccgccccttgttccccgccgaacctcaaaaccgcggttccttttaccgcgacaagaacttcgtgcgtggtgctgtgaaaatgatgatacggaaatactccgcccgtccagctgttagaccaatcgtgccggcggaggacggactctgctttctgtaccgtttcttcattaaataccgctttataaataacaagcggaagattcgggttattcggaatgcggccgtcaccttcgaaataaagcacttgaatatcctctttctgcattgtgttcacctccgtatatgtctgtttcccattcatcatttattaaaacgctattttctcatattccattgcgaagcctgccggtgaatagtatagtataaaaaaatatgtgtcaaaatgagggatttaatgaaagccatcgtgatcggaatattggcatctctgttttttgcagtcacatttattttaaacagggcgatggagctttccggcggaagctggatgtggagctcttccctgcgttttctttttatgattccgtttttatttttgatcgtttatgcgaaaggaaaatgggcgccgctctggcatgaaatccggaaaaaaccgtttttttggctgaagtggagttttaccgggttcgtgcttttttatgccccgattacgtttgcggcggcatatgggcctggctggctgatcgccggcacgtggcagattacaattgtcgcgggtgtgcttctgtcgccgtttttctgcgaaacaaaaaattcaccggcgggcccggtttccgtcagacaaaagatcccgctgatttcgctggttacttccgtcatcatcctgatcggagccgggctgattcagcttcagcatgcgggttctctgtccggccgcacgatactattcagcgtggcgccggtcgtcgtcgcggcgtttgcctatccgctcggcaaccgcaaaatgctggaacaatacggcggaaaactcgatacgtttcagcgggtgctcggcatgacgctcgcaagccttccgttttggcttttgatcgccgctttcggctggtatagagacgggcttccctcaatgggacagacattccaatcctttatcgtcgcactcagctcgggcgttatcgcaacagtattatttttccgcgccaccgatatggtgaggaatgagccgcagaagctcgctgctgttgaagcgacgcagtccggagaggttctttttgcactgatcggcgaaatcgtctttttatccgcggcgtttccgtcacttctttcatttgccggactgttcattattattgcgggaatggtcatgcatacattcgcttcccggcagacagaccagaaaacggcggagcaaacgtcagccaatctcaccggttcctgattttttacgaaaggtgtcatcctatatgaaagaagaaattccggcaatatcttttctgtcagccggcaaacgctttgaacaaaacaatacgtcctttgatgtcctaagccgtgtaaccggacatatccaaaaaggttctatcacggcgttgatagggccttccggcgcgggaaaaagcacattgctgtcactttgcaatctgatgaatacacctgatgaaggggaagtgcttgtattcggaaaagaaataaggcgctgggatatcagggagctcagaaaaaccgcgggccttgcatttcaatcagctcccgtcacggagggcacggtgcgggacaaccttctgctcgcagaaaaactccacggggcgcagcactatacccctgaagagctcgcagattttacagaccttccgcgcgggcttctggatcggaatgcgaaagaattatccggaggtcagcggcagaaactctcattagcgcgaactctcgccggactgccgtccatcctactgctggatgaaatcacctcggcgctcgactcctcatccgttctcaccattgagaaactgattacgaaactccatcggcaaaaacagctgacaatcctgtggatcacccataaccttgaacaagcagaacgattatccgatacggtatggtttatggctgagggacggcttttagagaccgcggaaacgaaaacgttctttaaggaaccgaaacacgaaaaagcccgggcgcttttacaagggagcgggtgctgatatgaatgatctttcactgttactaacaagtatatttgtcattatcgctttattcctgtctaaatcttttaaagccggtgtcgaaaaggatatgatcgtcgcaaccgtcagggccgtcattcagcttctcatcatcggctatgtgctgtcgctgatttttcgcggtgatcacccgatatttatcatattaatggtgcttctcatgctcacggccgcttcgcacaatgtcgccaaacggaaaaaaatgcggatcggctcattttggcgcgtttttctgacactggcaatcgcggaaaccgtgacgcagggacttttactgacccttcacatcattccgttcacttcaagatatgtcattccgataagcggcatggtcatcggaaactccatggtgctctcaagtctgtttttaagccggctcagttcggaagcagacctgcggaaagaagaaatccagctgattctctctctcggaggaacgcctaagcaggccgtccggcagatattgacgtccagtatgaaactcagtatgatcccgacgctagaaagccagaaaacattgggtctcgttcagcttcccggcatgatgacggggcagattttagcgggggctgatccgatacaggcggtgcgctttcagctgctgatcgtttttacaacgatggcctccgctcttcttacatgcatcatactcagcgccttgacatatccttcccttttcacggaacactggcaattaaaaaaattcagcagggaagcgtaagcttttttccctgctgaatggtggtttatgacaaggtcagagattcatagtaacgggataattcaattatcatcgctcccatccgctcaatgtccggagcaaggaccctctttaccccttcatcccggatcgcttcagccgtcactttgccgactgcggcggcaagcacatgtttttcgaatgcctgctgcaattcttttgcggatcctttttcttttgcataatcaaagagagagcgcacttgaatggctgtcgtaaaacatacggcatcgacctctccgtttaacagctctcccatcagtttatcgaccgtctccctttcaggcggaatatgctgatacggcagaacagggaatacctccgctccgtttttctcaaggaactccgttaaaaccggcgctttttcgccatgaagctgtatcataacttttttatctttaaagtcaaatcgttccaaggagcggatcagccctcttgttgtaccgtcttcatctgaggcatgcggcgtgatgccgagcttttttaaggccgcatatgttttatagcctctgcagccgattttcgcttcatgaatggccgctaaaaattcttctttcagaccgattttttccgataccgacaataacgtttccgtaccgatgcctgtggtgaatatcacccagtcggctttttgctcggcaaatgttcttacgtcgggttccatttgatcctccgccaggtatacggttccttggagggaacggatgaccgccgttccgccctgcttttctattaattttgtgatctcttctgttttccgcgaaccgccgatggcaatccgtttcccgttcaatccttttcccatcgctgttttcttcttcccttcagatgccgggcgccctatggcaggccgtcatttatttctattattgttacgcaatcagacgggaaaatcaagctatgctcccgttgaatcccccgtgcagttgctgtatcattaaccggacagaacgatttgattcgcggagggactttcaatcatggaaacaaaaaaagagttcgagacaaaaggatacgatacttcggtcatttatgagttcaatgaatatcctgatgttcacagcggccgatgtgacaattgcgactacacgctgtttaaaagctcagtgaagggcggaaaatttttgagggaatgccggagatgcggcatgaagaaaaacatataacaaaacaggcagccgtccggtgctgcctgttttcctaatcaattttcgacggacgccgttttcaaaaattcttcaatggcgcaaacagcctgttttggaccgccggtttcttttattttctgctgcatgcttttcacgcggctgagaatgtttttatcgccgtatacgttctgaacgtctttttgcagacgggccacagtgacttctttcagcggcagatgcacgccaagccccaattcatccacacgctttgcggtgacctcttgttcgtgcatttgcggaacgacaacgagcggaacacccgcattcatcgcctccattgtactgttcatcccgccgtgagatacgaacagctttgctttctccagcacatcaagctgcggaacgtgctggcggatgataaagtgatcgggcacatccgaaaaactttccggatcaattgttgtgccgactgacataataacccgccagcccgagtcccgaaacgcgtcaatacacatccggtaaaattcaggccaggcgttaaacgccgttcccagtgagatgagcataagcggacggtcatcggctgcatcaatttccagacttcccgtatttgtgcgttccccaagagacggacccgcaaaacagaatcgttcatcaaaggtttcctgtttcggctgaaaggcccttggcataaagacgatattcaatttttcaggcatgaaaaattcttccattgtcatccgtttcacttgttcattttcaattttctcctgatattcttctatcgcctgtttggccgcttccatcgtttcttcgtctcttcctaattgaaaatactcattcattgcataactcgggcagaactttacggccgggatgccgccattatccgcaaacaattttccggcaagcgctaaaaaatcaaacaggacgatgtcaggaaggtcgtctttgtacagctcttccagctgcggaagcacttcaaccgcttcttccagaaacatcacaaacgcgtcacttttgtttacccgttcttttatcgtcttcgggtccgcctttatgcttgtgcggtataaaacgggaatggcacccgttttggcaacggaagcttcaaattcctcagtcgtagcgaatgtcactttatatccgcgattgacaagttcctcggctacaggaagcgtgggattgacatgaccgtgagcggccacattaataatggcgatgtgtgtttttctcatcttttttcttctccctcattttcgtttatctcggcttctaaagactccagcccgtacatgacactgtttcggatcggctcaatccgaacgggctcaaggtgtgaaaaggcttttacaattcctttcagtgcggcttccgcttcaagtctggcaagcggagcgcctaagcagaagtgtacgccgaatccgaaggaaaggtgcggattcgattggcgatggatatcaaatacgcccgccttctcaaatttgttttcatcacggttggcagatgcaacgtagcagagaacgatctctccgcttttcaagcggcgcccgcgcagttcagtgtcgtgccggaccgtccttctgacaaacggagcgggagcgcgaaaacgcagcgtttcttccactgtttgcgcgatgagagaagggtcctgtctcagctcttcataaaggccgggcgtctctaatatgctgtaaaccgcatttgaaatgagattagtcgttgtttcatttcccgccactaaaagcaggttgcaaaacgggatcagatcttctggcgtgagcttctctccctcttcttcctcttttatcaaaatagaaataatatcttggccgggctgttttcgtttgctttctattattcccgcaaaaaacgccgccagctccgcctcacattggtcacgttcctgctgatttttctccgccgcttcaggactcgcatctttcggcatgctgacgagaatgtccgaccattttttaaactgatccatacgctcggacggaacgcctaataattctgaaatcaccatgaccggcaaagggtaagagagatctttaacgatatcaatccgccctttgttctttgcctgtttcaggagatgatcggtaatgtctttaattctcggctcccattccttcaagacacggggagtgaaagcgcgattgacggcagatctgatttgggtatgtttcggcgggtccatattcagcatggactttgcaatcgagcttttcacatcagtcatgcggcttgagaacgtctctttatcactgatgacttttttgacatcatcgtataaaaacacactccaaaccttcgtttcttcatcaaagtatatagggctttcacgtctcattttttcataccaaggaaaagggttgtatacgtccaggccgttttttcctttcatcagggttctttggatggcttgtctcgtgctcctcagcttactcatgttacatcactcctgattgtttcatatttgaatagttgacgtaccttgaattttatcctagcacatattttcaatttttttctattcataaccttaactattaacataacacaacaaaagtcatgaatccggaggtgaaatttctcccaagaaaacagcagaagcgcacaaaaaacccgagccttcagccaggctcgggagaaatgttcactcattcgtctgcggtttctggtgctgcttttggtcttcaggaggctgcgtatttctttccatatcgtccgtatcagcgcccatgcctttcaggaaagaaaacagcagagtgacggccttgttgatttccgggtcttttaaagcgcggacgatatcaaaataacccgtcttcctgccgctgtctttttcttcgacggcctttgtgacgcccgcattgattttaacgataaacggctcaagctgttttacatcgagcatgccgagaacgccgcttaacagcaggagatttttcagcatattggccgtttccggcgtattcgccttcttcaccaggatatccatcactttgtctccttggccgaagagcccgcgcagaagcgccaaaacgccgcgctcgttcatgtgctgaagaatgtgcagagattccaaaatcgcgtctttatttcgtaaaagagccgtctcgatctcttctaagtccttttttcgtttgtcttcttctgtgacggtctgttttcggatgccgctgattgctttagccattctgctgtttccccctttttacggcgtctcccggaaatacataatcttgacgcgcccatttccgatcaacccggacaccgatctgcggctgcgggtttccgtaacggaaattgattttcggaagcggattaacgccttcttttttcaaaatctccatcttcgctgatgtttctttatatgccggtgtatcggtatccttatccgcatagctgcttgtcaaaaggttaatggcggcgtcttttgaatcgttcatcgggagatagacttgtttgccttttaccctgtctgtgatgacgcatttgactttcacatttccgtacggtgatgtcagacggacaagcgttccgtcttccagccctctttcttcggcgagttcgggcgagacctcaaggaacacactcggtgttttttcggatattccttttgatcggtaagtcagattcccttcgtgaaaatgctcgagcagccgcccgttattcacatggatatcatattcttcatcaaattctttcggctcggtccactgaacgggatatagaatcgctttgccgtctgaaaacggaaacttgtccgtaaataaaagcggtgaatcggttccgtccgctgctaccggccattgcagtgaattgtagccttcgagacgttcgtaagtgacgcctacgtagagcggcgaaagcattgccgcttcttccataatgtctgccggatgttcatagcgccaatcagcgcccagccggttggcgatgtccgtaatgatctgccaatcaggctttgaatcgcccagcggttcaaacacttcgtaaaggcgctgcaccctccgttccgtattcgtaaacgtcccttctttttcaagactcgggcttgccgggagcaccacatcggcgaactcggccgtccgcgagagaaaaatatcctgcacaacgaagaaatcaagcttttcaaaggcggcatgaacatggttgatattggagtcgacaagccccatttcttccccttttacatacatacacttcagttttcccgagtggatgccctcgatcatttcatgatttgtcattccgatttctttcggcaggtctgttccccagccctgttcatactttttgcgggctttttcatccgttactttttcatagccggggaagctgtcaggcatactgccgaaatcactggctccctgcacgttattatggccccgaagcggatatgagcctgcgccgggcttgccgtaatttccggtcacaagaagcatgttggaaatggccgtgctcgtatcacttcctccgatatgctgggtgacccccatcgcccacagtgcgcatacgcttttggcttcatgaatcatccgggccactttaattaaggtatccttgtccacaccggtatgtttttccgcatattccatcgtataaggttcaaggcttttcacgaattcatctaatccgttcactctctccttcagaaatgcagtatccgccaaatcgtgatcaagcagatatttcgatacggcattcagccagacaatatctgatccggcacgcggctggaaaaacacgtcggagcgctcggccatttcatgttttcgcaagtcagcaacgacgagcttctgtccgtgcagcttatgagaacgtttaatgcgtgtggacaggacggggtgagactcagatgtatttgaaccgataatcagcacgagctcagctttttctatatctgtaatcgaccctgaatcaccgccgtatccgaccgttctgaacaatccggccgtggcgggagactggcagtagcgtgagcagttgtcgacattatttgttccgataacggctcttgcaagcttctgcatcacgtatgattcttcattcgtgcatttggaagatgtgataaacgcaagcgcgtccgggccgaaatgttcttttatatcggtaaatttatcagcgatcagctgcagcgcttcatcccattccgcctcccgaaacgagtctccttcccggataagcggtttggtaaggcgcttttcactattgacgaaatcccagccgaatttccctttcacacacgtcgaaattccatttgcgggcgcctcagcctgaggctcgacctttaaaatgtctcttcctttcgtccatatatcaaaactgcagccgacaccgcagtatgtgcatacggttttcgtttttttgattctttcatcccgcatggccgattccatatccgatatggctaaaattgatccgtatccggtttcgacgccttttgtgatatcaatcatcggccgaagcgtctcttggttaatgcctgttaaatacccagcttcgccttccatgcctttttccatcatggcattgcacggacataccgtcgaacaatgtccgcaggaaacacatgatgattcattgatcggcacatcctgatcccaaatgacccgcgggcgtttccgctcccaatcaatgcttaaggtttcggttacctgtacgtcctgacaggcttcgacgcagcgtccgcacaaaatgcactgatcgggatcatatcggtaaaacggatttgattcatctttaggatacggtttttgatcgaacggaatgctttgatgattgattttcatttcctttacggtattatgtatttcgcagctcccattgttgtaatcacagaccgtacagtacaattcatggttgtgcaaaatgttgtccatgccgataacctgcgctttttttacatcggacgaaagcgtatcaatgacatctccgtcctttatttgcgcggaacacgaacgcaccagttccccgttaacattgacgatacaggtatcgcacgtttcaatcggcccgagactcgggtgataacacacgtgcggcacgtcaattgaactattgttcaaaagctgcaaaacggtttggccgtccggcgcttccatttcaaccccattgattgtaactttctttgtatcagccattttctttcccctttctgtacccctctatacatcctctatgattcccaaccggcctttcactaaaacatctcgtttatctcaggaaacatacgggtatgagcggtaaaaaggaggcgttcacatgttgaagaaaaaaacactcgtcacgggattatcggcagtgatgctcacgggatgcgctttcggagcagaagcattttcggatacacagcccgtccatgccgcagccgcttcaaaaacggaaaaccagcgtgcacaagaactggtgaacagcctttaccaatcggcatttaaaggggaaatgccgcaaaatgtgaaaggcctgaaaatcaaccaaagcacaagacaggacgtttacaataaaatcggcgagccggaacaaaaagcagacagccgcaatccatttgatttatacagctggaacatgggaaaccccgggtatggattttcctatcataaaaacggaaaaatctcggaaatacgctattttggaacgggggtcgagcggcgcttaaacctcggcagcgtcacacctgacgtcttaagcaaacaaatcggcagcgctgacaaaatcctgacagtgccagaaacgggcgaaacagattacgtctaccatacggggcagtatgagctccgcttcgtcatcggcagtgatcaaaaagcagatcatgtcaacctaaaagccagataacgcaaaaaagcggcctcccgggccgtttttttcatagacagcttctccgtcgttccttacaatacatgggagtacaaaaaaaggggaacagtgtgaagtgaatagacatccattgacatacggaatatgtaccgtttttatcatcgccctcggtttgctgtccagaaccgcatacatcaccgccctattgcccggcatcataaacgcttatttaggagatgccttgtgggcggccatgatttttacaggattcgggcttttcttacggcacatccggacggaaacagccgcaattttgagcctctcgttttgctgtctgattgaatgcagccagctgtatcacgcgccatggattgacgcgatcagaagcagcacgctcggcgggctgatcctcggctggcaatttgtctggagtgacattttcgcctataccctcggggtatgcgctgccgcacttttagaatgggccgtaaaaagaaaccgccagccctcttcataatcggagcacgccgccgatatgaagggataaggaggtggaagctatggatatccctgcgttatcaatcgcaatgcatcagtcatctctggcgcagaatgtaaatatcgctttaacaaaaacggtcatgcagcatgcacaggctgcggcggaagaaacagtgaaaatgctgccgtcccagcacccgactgccggccattcaattgatgtgaaagtgtaaaaaaagatgccggatgataaccggcgtcttttttttgcccattgtacatacaccgtaccgggcatacaggaataaggtaaacggaaccaacatttgaaaaggaggttttcctcttgtacgatcctttcgatcatgaatacacagccgagagccacgaacgggtgccatatcattatccgcggccgccttattattaccccagaccatatccatactatccgcggccgccttattattaccccagaccatacccatactatccgcggccgtatatcccgttctatccttggtattaatgtttgaaaagaaatgactgcagacaggaggcttcccctgtctgctattcaactttgaccgacaggatatacgggagggcttgaactttctccattaccgctgctttcccgcttttgcttttcacccttcccttcacttcaagcaccgccttattcaattcataggacgtaatcagaattcctttttcctcaagagaagttaaaatatcatgcatgacggctttctcttcaatcctgaaactgacagacaaagaatgcgccgccggtttaaacagaaaatttaacagttcaagcccgattaacgccaaaatcgtgccgctgatgccgatgacatacatacctgccccgatcgtcagcccgatccccgacgtagcccaaatccccgcggccgtcgtaagcccccgcacgacatgccgctgcaaaataatcgtgccggctcctaaaaatccgacgccgctgacgacctgcgccgccacccggctcggatcaaaggacgtatggctgttggataacaaatcaaaaaagccgtatttggaaacgatcatcatcaaggcgctgccgacggccactaaaaaatgcgtcctcaaaccggcttcctttgccctgaattctctctccaatccaataagagccccaagcagacccgcaaccgccagacgaatcacaaaatcaagttccatccgtctctctcctttccttatcttcttacccgcttttataacccaatcatgcggtgtatctttttttaaaatgcaccgactaattgacataaggaggttttatgaaatatattctgtggttttttatattattgttatttagcttatttattttgggaggatataaagcagctgtttctcaccctgatttcccggtgccattattcgctatgcacactaaaacaaaggaatatgaaaaaggaaaatacgtttcaaactatacataccgtttcgcaaaagaagaagaaggtccgagcggtttataccaattggaaatagccgaaaaaggctggaaacttaaagggcaggaaggacttatcaaaacctatgaaaagcgaggagaacgtgtttcactttttttcggtacgggggaaataagcgtcattgaagaatgatccttctcaaaagacaggctgaaatccgcaaacggcatatcttttacgactcccttatctctgcgaatctataaattcagccaatatttcaattaaggcgaacacctttctgatgcaaaaaatgccgccttcaatgagaaaatcattatacaaaaacaaaagcgcaactgaaaaagaataagcacctcataaaaaaagccctctttttaaaaaagagggctgcagaaggaaaacaggtaattatttatctaaagtgtactcactcacattaaaagtaagaatgtttccaaaaacaatatggtcccttctattttgaaaaggccctatattattatagtgcttctcgataacatatctagataagcctattccagaacttttttgatcataccatctgataaaatctttaatctcttccattgaaagatcaaattctttctcaagacctgtggtcattgtaacaagaagaattgcccgattactggcgggctgtttatttggtggttcctcaggattctttggttctccatctttatcctcttcggtttttaccggagtaagagcatgcagatattctaatgcatatccagacggcgttagaccgccaaaaagataaagattgtctccaactgcggctattctggcatcatatctttcaaaaggatagggtttttctacgctaatttcatctttaattggatcatatacttttgttaaaggctcaatcacacttggattttttctaccgccaataatgtaaatcttattattaaggacagctgtcgaagtattttgcaaaggtcctaaaaattttttgcgattccatctatccataacaggatcatattcgtaaatatattcgtttagatcgcttctgatatgtccttgaactacttctttagtttgcccgccaactaaataaatctttccgttaaaaacttcagtttctgttgcatatatattaattgggggcgcttttttaacactccaagttttggataaagtatcaaaagcataatgttgcgaatgagcagcatcggtgtcgaatcccccaatcaaataaattgtatcgttaataacagcggctgatgcatggcaagtcggggtcggaatatcaggtacacgtccccatgtatttgttttagtatcataaacatctacagagctgtaaacatttgctcccttataaccgcccaatacataaatataattacctatcactgctgtgcatgaacctaccctgggtgtgggtatatctaatccttgcgtccatttttgacttatggtgtcaaaactataatttttgttatatttttgattacgtgcacctcccaatacataaatagagttacccacaactgctgattcaaaagcataattaggttcaatcatatcaagtaatcttgtccacttgtcatatttctctgtcaatttattcattcctctcatctttgtgataattccatttatagatggcgatcgtatgacaagagattcatttaactaagcgatccaagatcacttactttcgatcaaagaaatattgaaaaaggcctctggatttaaaagtgatttggttttcacttctcggttattggccaacagtttactaaaaatttagtatataagtgtaatatagaataacacctctcaatgaatccttaatgaagctcataatagcttcaaccaaaggcatttcacattaaagtaaagatcactctcaatccaactgcatctctcaaacagaatgtccggcaatcacctcaaaaaacgaggtgaaatctgtcagtatcccgtcacccgccagctgtttttcttcaaatagcgcgcggttttttccgtgcgggtcaatggccataatcttgcccgcacctgcttttttcgccgctgtgagccccgaaaaggcatcttcaatgaccaagcattcttcaggtctgaggcctaacttttccgatgcgatgagaaaaatatccggcgccggttttccggggaagctcccgtcatcaaacgtgactttgtcaaaatcaaaccactgatccaaatgaaagacgtcaaagtaaaactcgacattttcctttaccgtagccgtagcgatggtcatcggcgtttcagattttttcagatgattcaatacgccggtcagtcccttcgtcagctttaattcgtctttgttttcaaggcataattctctgtagtaagcttctttttcaaaagacagcttcctgatttcttcatttgttaaatcgccggaaataaaatacgtcaggatttcactgtttgttctcccgtgaatgttaacgaaaatgtcttcatcagaaatggttttcggcgcgtattttttcaccatgaaaaaccatgctttttcgtgcagatgcgaatcttgaaacatcgtgccgttgaaatcaaaaataacccctttcatcgaaccgcccgccttttttatttttttgcgattttgacatctacatattgctcgtaatgaatttgaacatctttcatgactttatcatccgtaatcagatagtccatatcgtgcaagttatagaacacgtaaaaatcttcccggttaaattttttattatccgccagcaaaaatttcgtccgcgaattattcagcgcgatttggtgagcttccccttcttcaatgctgtaagaagaaatctcatcattatgtatgccgttggcgctgatgaaagccttcgtaaaattgaatttctgcagattgccgttcacgatggggccgacgaaggcaccggtattttttcggaagtcgccgccaatcaggatggtatccgcagtgtcgccatgtttcaaaatatcaaatacgggatagttgtttgtgataatcctgattcgcttatgcagcaggtgtttcgctaaaagttcaatcgtcgtgccgggccctaaaaaaacggtatcgccgtcatttacataggaagctgcgagttccgcgatcttccccttctcctccatttgaacaccgagtttttcattatgcgataattcgtgatcaatggaataagatatgctctgtgcgcctccgtgaatacgtacgatttttccggccttatccagctcgtccagatctcttctcactgtcatatcagaaacttccagttcatcgataatatcactcaccgtaataaaccccgcgagtttacgatatcgatgatttttaaaagtcgctctttttttaacatgttcaatcatcccctcaactttacacacaatctaacatactgcggcaatccggtcaacaaaaataaacattaacaaacaacataatcaacatgtaaaacaacgaaaaacttatataacctctataaacacagatgttatttctttatgaagctattgacaacaaaaatatatgcgtttactattaaacaaaagacaacaattacaaacattaacaaactccaattcacacattggcgaaggaggattcagtaatgctcaaattacctcatgactttattttcggcggggcgactgcggcatatcaagcggaaggcgccacaaaagaaggcggcaaaggccctgtggcctgggatgaatttcttgaaaaacagggaagattcagccctgatccggcaagtgatttttaccgccagtttccggaagatattaaactatgtgaaaaattcggaataaacggcatccgcctttctatagcctggacgagaattttccctgacggcacgggcaaaatcaatcaggaaggtgttgattactatcatcgtattttctcagagtgccataaacgcaacgtcaccccttttgtcacgctgcatcatttcgatacaccgaaaggattatttgatcagggagatttcctcaaccgcgctgcaatagaagcgttcgtcagctatgcggagttttgctttaaagaattcagcgaaatcagatattggagcacgtttaacgaaatttatcccacagccaccaaccagtatttactcggggttttcccgccatctgttaaaagtgatatcacaaaagtcattcaatgcctccatcacatgatggtagcgcatgcgatgaccgtcaacctttttaaagacggcggttatccgggagaaatcggggtcgtccactcattggaaacaaaatatcccgccagcggcacagaagaagaccgccacgcctgttttctggatgacgcgttatcagtgagattcctcctcgatgccacctaccttggctattattctgaggaaaccatgcgtgctctggatgaaatctgtgaggcaaacggcgcttcatacgagttttcagacagtgactttgacgtgatgaaaaaagcctcaacgcgcaatgattatctcggcatcaatcattatcaatgccatttcgtcaaagcgtacgacggagaaaccgttattcaccataacggaacgggcgataagggcacttcggtctataaagtaaaaggaatcggcgaacgaatttacaaagaaggcctgaagcggaccgattgggactggctcatttaccctgaaggcatgtatgacatgctgatgcgcatcaaacgggactatccgcaatataacaaaatttacattaccgaaaacggcatgggctataaagatgagtttgaagacggcatcattatggataaggcaagaatcgactatttaaaagtatatttagaagccgtcagtaaagcgattaccgacggagtcaatgtaaaggggtacttcttatggtccttaatggatttattttcatggaccaacggctacaacaaacgttacggtcttttttacgtcgacttcgacacccaaaaacggtatccgaaagaatcggcctactggtacaaacttgtaagtgaaacaaaaacaatcatttaacgatcatacatgatgaaaagaatctctttccatcatgtgtgccgtctttaggaggtttttttcatgacaaaggaagaattgcagatgctcggttttgaaatcgtcgcctatgccggcgacgccaggagcactttattgaaagtcctgaaagaagtccgtgccggaaacttcgaaaacacggaagcagcattgaaaagcgccgatgaaaatttaaccctcgcccacaatgcgcaaacgaaaatgttagctgaagaagctgacggcaaggacatggaattagggtttattttcgttcacggccaggaccacttgatgacaacccttttgctccgtgatcttattcaggattttatagaactctaccgaagccgccgataaggagtggaaaaatgaacggtatcatcaagcaaatcgaaaagggaaaaccgtttttcgaaaaaatctcaagaaacatttatttaggcgcgatccgcgacggcttcttaactgccatgcctgttattttattcgccagcattttcatcctcaccgccgctgtgccggaagtgttgggtttcacttggcctaaaagtgtttctgaatggctttggaaagtttataactattcaatgggcgccctcggtctgatcgttgcggcaacaagtgcgaaatgcctgagtgaatcaatgaaccgaaaaatgccgaaaaacaaagggatcaaccccgtttcagcgatgcttgcttcagtcgtcgggtttctcattttaagcgtcactcaaatcgacggcgggttctccgcggaatatctcggcacaaaaggtcttttagccgcttttgtatccgctttcataacggtgaacgtttacagattctgcgtgctgaaaaatattacgattaaaatgcctaaagaagtaccgggtaccatttcacaaacatttaaagatgtttttccgttcgctttttccgttttggccatggtgatcgttgatttattgatcaggaatacgctgaatgtatcgtttgcggaggctctctcctctctcttatcgccattttttaccgccgcagacggttatctcgggatttgtgtcatttggggaatgatggcgctgttctggtttgtcggcgttcacgggccttctattgtagagccggccatcgcagctattatttacgcaaatgtggaggcgaaccttcagcttcataatgccggcgagcaggcgtccaacgtgctgaccgtcggactcgggaacttcgtcggcacaatgggaggaaccggcgcaacccttgttgttccgtttatctttctgcttttcgcgaaatccaagcaattgaaagcagtcggaaaagcatccgcggttccggtgtctttcgcagtaaacgaacctcttctctttgctgcgccgatcattttaaatccttattttttcattccgtttgttgtaacgccgatggtgaatgtctgtctgtttaaatttttcgtggatgtcatcggaatgaacagttttatgtatgttcttccgtgggccaccccggcgcccgccggcttgattctcggaaccggcatggggctctcggcttttgttctgacggctgtattaattattgtcgatttcctgatatacctgccattctgtaaagcttatgacaaagtattagcggcggaagaagcccaacataccgaacctgaaaccgcgccgcaaaaatcccgggagatacagcccgtaatggccggcgcctcagaagacgcggccaccgtcatcagcacaaatcttcaggaatcctcatccgccttggaacacggcaccaatgtgttagtgctgtgcgccggagcgggaacgagcgctatgcttgcgaacgcactgaccgaaggagccgaagaatacaacgtgccgatcaccgcctcagcaggcgcctacggatcccattacgacatcatgaaagacttcgatatgatcattttggctccgcaagtcggctcttattatgatgacattaaagaagatgcggaccgcctgcatgtgaaactcgtcgcaacgaaaggagcggaatatatcagcctcaccagaaattcacaaaaagccattcagttcatactggagcatacctcaaaatagaatcggaggtttaccatggatgccaaacttttgaaatcaagattcgaagacattttcaagagaagtaacggagaactgtttttcgcacccggccggatcaacctgatcggggaacatacggattatataggcggtcacgttcttccatgcgcgatcacgatcggaacatatgccgtatgcgcaaaacgcgaagatcaccagatccggttatactcagaaaactttcctgacagcggcattgtctgccttgatctttccgccactgcatacaaaaaagaagacggctgggccaattatccgaaggggatggtccattaccttcttgaagccggcggccaaatagacagcggaatggatattctttttcacggtacgattccaaacggagccggtttaagctcctctgcttccattgaaatgttaaccggttccattttaagaaagttattcagcctggatgtttccgatactgaactggcgcttatcggaaaaagagtcgaaaatgaatttatcggcgtgaattcagggattatggatcaattcgcagtgcaaaaaggcaaaaagaacatggccattctgttaaactgcgataagcttgagcacgaaatgattccggctgcttttaacggatataaaatcgtcattatgaatacgaacaagcgccgggagctggcggcttcaaagtataatgaacgccgcagcgaatgcgacgcggctctcacggaactgcggcaatatcaaaatatcgcatcacttgcggaattgacgggagaagaattcaacgaactcgaacctcttctctcccgtgaaactttgcgtaaaagagcccggcacgcggtcaatgaaaacgagcggaccctctcagcggcggaagctctcaaatcgaatgatttgaaaacgttcggggagctgatgaatgcgtcgcaccgttcgttacgtgatgactacgaagtgaccggtgacgaattagacgcgctggctgaagcagcctggaaagaaggagcactcggagcgcggatgacgggcgcggggttcggcggctgcgccatagccattgtggaaagtgaagaaaccgccggctttatccgggccgtttcatctcactaccgcagcaggacaggtcttgaagcttctttctacatcgcggatataagcgatggcgcggctgaatggagggaaaaataaatcatggcgattctcgttctcggcggagccggctatatcggttctcatgcggttgatcaattagtaaacaaaggatttgaaacgatagctgtggataatctccagacaggccaccggaaagccgttcatgaaaaagccgttttttaccatggagatatccgtgacaaaccgtttcttcgctctgtatttgcgaaggagaacgtaacaggcgttctccattttgccgctcaatcccttgtcggcgaatcaatgaaagaccctctttcatatttcaataataatgtgtacggtacgcaaattacgctggaggtcatgcaggaattcgaagtgaaacacattgtgttttcttcatccgccgctgtttacggcgaacctgaaaaagcgcccatcacagaagacatgccggaaaagccggaaagcgcatacggcgaatcaaaactcatggcagaaaaaatgctgaagtggtgcgataccgcttgcggcataaaatatgtctcgcttcggtattttaacgttgccggcgcgaaaacggacggttccatcggagaagatcatcatccggaaacccaccttatccctatccttttacaaaccgcgctcggtcagcgcgaggaggttttgatattcggcactgactatgatacaaaagacggcacgtgcatccgcgattatgttcatgtttctgatttaatcgatgcccatattctcgctctggaatatttgcaaaacggcggagacagcggcattttcaatttaggatcaagcagcgggttttccgtatcagaaatggcggaagcggcccggcaagtgaccgaaagagacataaaagtaagagcgtccgcaagaagacccggtgatccaagcgccctcatcgcttccagcgataaagcgcggaacattctcggctggaatccgaaacaaacggacatatcggaaatcattgcgtcagcatggaattggcatcggcatcatcctaacggatacaaggacaaatgaaatggaggcggcggtcattgacgtttttgaatcagtggcagggtttctgaaagaaagcactgtcttaggcgacataaatgaaacagatgtgatttatacaagaaacagacttctcgatctgctcggactgacggattatgcagaaccgaaacgtatcaagaaacaaaacaggcttcactatttggacgaaatggtgaaagacgcggtaaaacggtcaatcataaacgatacgccggctgaaagagacatgctgggaagcagaatcatggacgtaatcacaccggccccttctctgatcaatgacgcattcagcgaattgttatcagattgcccgaaaaaagcaacagattatttttatagattgagtcaaaacaacgactatattaagacgcgggccattcgaaaaaatatcgtgtaccgctcaataacaccttttggggaattggacatcaccattaatctatcaaaaccggaaaaagaccctaaagacatcgccgcggtaaaaaacagtccggaaaaccggtatccgaaatgtctgctctgtatggaaaacgaggggtatgccggaacaccgcatcaccccgcccgttcaaaccaccgcatcatcaggcttgacttagcgggagaacagtggggttttcaatactctccttatgcgtattacagcgagcatgccatctttctttcaagcgtgcacaagccgatgaacatcagccgcgaaagcttcagaaggcttctggccattacggaaattttccctcattatttcgcgggatcaaacgcagacttgccgatcgtaggaggttccattctttcacacgatcattatcaaggcggcgcccatgagtttcccatggcaaaagcgggttccctctacccttttcatatgcgtcattttccagacgttcaggccgaagccgtgaagtggccggtatcagtgatccgccttcgcgcaaaagatccggatttgctgacagatgccgctgcgtatgtttttgaaaagtggcgggaatattcagacgaaaccgtcagcatcatcgcgaagacaaatgaaccccataataccgtcaccccgattgccagacgcaggggaacggattttgaaatcgatctcgctctcagaaacaaccgcacctccgaagattatccggatggcatttttcacccgcatcaagacgttcatcacatcaaaaaagaaaatatcggtctgattgaagtgatggggctcgccgttttacctccccgtctgaaagatgagctggcagaagtgaaaaagtatttactgaatgaacatcatgacatcaaggacattcatcttccgtgggctgaaaacatcaaagcggataaagacgtgacaccggaaaatgcagccgctgttttacaaagagaaaccgcgaatgtatttttacgcgcgctgaccgatgcaggcgtttttaaaatgacacccgaaggaattcaggcgtttcagcgtttcacgacgttattggagaatgacagctgaaacattcagagtgaaatcaatcaacaatcttttttatcaggaggtattgtgatgttcaaaaaccgattgaaacgtgtatttgtaaacgcaatctgtctttctctcattttcaccgcttttacatttcttgagaagtctcctaaagcaaaagcggatgccccgtttgcctatggcgctgatataggatggctgaaacaaatggaggatgaaggtgtgcgctggctggatgacggcgggaaacagaaagatgccttgcagattcttaaagatcacggaataaatgccgtgagactgagagtgtttgtgaatccgccaagcagctattattggctgaaagacggcacaacatggacgatgctcggctatagtgacaaagcgggcgtacttgcggcggccaaaagggcaaaagcgttaggaatgaaagtaatggttgacttccattacagtgatgtgttcgctgatcccggccaccagatcaagccgaaccaatggaccggctattcaaacagccagctgcaggcagccgtgtataaccatacgtacgatgtcatgaaagaacttaaaaatcacggcatctctcctgattgggtgcaagtaggaaatgaaatgaattcaggaattttactgcccgacggcagcacgagcgatttcagcaaattgaccggcttactgaacaaaggctatgacgccgtgaaatccgtcagcccggccaccaaggtaatcagccatttagcacacggcacggacaacagcctattcagatggtggtttgatcaattctttaaaaacggagggaaaaccgacatcatcggcgtttcgttctatccctattgggaaggtaagccgtactgggagctcaccggccatttatcatctaatttgaatgacatcgcctcacgctacaacaaggaagtcatggtggttgaactgggcggagatgaaaataatccgaaagattcctactggaccataaaagacaccataaaactggtgaaagccgttccgaacggcaaaggaaccggcgtattttactgggaacccgaagctcactccagcgttctgtcagatgcgtatccattaggcgcaaccgcaaaagtgtctaaaaacgtcttgaaatacacaaccgcaattgacgctttttatgatgccgcaacaggaaaatgattgatgcaattctaaagcaggctcttttcgcagcctgcttttttgtaaggctgcagagttagcctgttatgaagagctaataacgaatacggaaagaaacatactcgaaaaaccacatttcggttaaaaataggatacttcttctgttccccctccttcttatttctgcgcactatctctcagttcctaaataataactttacgattgttgaaaaagaaacaaacattttataatattgtgtaagcaccaccgagcaggaggacgggtcatggacaaaaaagaacagctcctcacggatttcagggacttttttaacaagatggtgtggctgaataggctgaagatggaagaaagccttaaggggcataaaccttctgaagtgcattgcatcgaattcatcgaaaaaattgaagacgccaatgtgacaaaacttgcggagtccctttatatgacaagaggcgctataagtaaattaacgaagaagcttatcaataaaggccttatcgaaagctatcagaagccgcttaataagaaagaaatctatttcaggcttaccgagcaaggaaaagtcatttataaaattcacgaggaattgcacaaagagtttcaagaacgggacaaaatcgtgtttgaacaagtaactgatgaacaatttgacacgatgctgagcttcgtggaaacatacagcaggcatttggattcagaaataaagaaacttggtgcagacatgaaatcggaataaaaccataggcagccctgctccatgaaaacgggctgcctttttatatccctcttattgttgacaaagaaacaaaatcactctattattttgttgacaaggaaacaaatacggcgattttgagaggagaataatatgtcaacacataaaagaaaggaacttcggctgccaaaagaagttctcacagccgcctgggctattgcactgggagcaattgctccaatgcttgactctacgatggtaaacatcgccatcgacaaactgaccaaagacttcaacacgacattggataccattcagtggtccgttacaggctatatgttagcacttgcgattgcagtacccgtatccggctggcttatgaataaatataacggtaagaaaatcttcatcggctcagtcatcgcctttggtgtcatttctgtttttgcgggaatgagccgtgacgtttccagcttcatcttcttccgtttgcttcaaggattcagcgccggcattatcactccgcttatgtcaacactcttggttaaaacggcaggtccggaaaacctgggaaaagtgatggcaatcgtcagcacccctatgatcttcggcccgatcttaggacctgtcatcggaggcttcatcgtccaagtcgcttcatggcattggattttttacatcaacgtgttcatcgttttggttgccgcaccgcttatgatgaaaaccattccagactttgaaccattcaacaaagatcgtaaactcgatattttcgggattatcaatttgtcattaatgagcgcggcattgatgtacggtattacgaaagcggcggatcatgcatcatttaacaatagcgacaccattttatgggcgggcatcggtcttgtttcagcagtcatttatcttgtatataatctgatcaagaaaaaccaaaccgtgctgcctatgaatttgtttgcaaacaagagcttcttagcatcttcgatcgggttgttcttagcgaatgttgccatcatggggccgatgttaatacttccgctgttttttcaagacattcgtcatttcacggcagtcggagcagcactcgctttaatccctcaaggagtcggaatgctcgtgactcgtccgctgatcggaaaaatgattgataagatcggtgcgaaatacgtggttacggtcagtcttgttctttcgctgatcggatctatcccgcttatttttatcaccgataacacaagtatgatttggatttccgtcgtattatttatccgcggcaccagttttggaggaattatgctcccattaatgagtgacgcttatacaggtcttgacagcaaacagcttccggaagcaggtgtcggtattcatatgattgaaaacctcggttccagctttgggtcagctgtgatcgcaaccgttaccgcaactgtcatacaaggattgcagccaacgattccgaacagtttaaaaggctaccatgccggattcttagtatccgtcatcatccttgcggccatcttcattccaagtctgttccttacccataaaaagactgcgatataaagaacttttcaaagtaaaaaacccttgcgcagcaagggttttaatgaatgaaactgatgattgttgccggcagagtcagccaacaacatacaaagccttttactcattcacattgcttttcattaaccattctacttccgttaattcttgtttttgaacgtcttttgtgtgctttttcgtaaaatggactttaacagcttcttcgttttcccaaatctcccaaagcataattttgcgttctgatggttcaagcggatgagcatggaactgaatacagccttcttctttgttcgtttcttcctcaagttttttgaattccttcattatttcattaaggtctttatcactgatgatttttaagcatgccgttatgtaatgcatcgaaactccccctcttcccatcattttatggctttacattataacatcgaaacccgcataccgcattctcaacatataaaaaaccgtccataaaaaatgaacggcaatgtttatttaagatcatgaagagcgacttttgcagcctcagcgataagagcattatgataatcggcatcttctgtaaatcggtttgacaggattgccaaaacaatcggagctctgtcaggcggccaaacgatggcaatgtcgtttcgcgtcccgtaacttccggctccggatttatcgccgacttcccatcctgcaggagcgcctgcccgaatcagttcatcgccggtagcgttgccccgcatccaatccgttaagatcgtgcgcttgtcagtcgtgagagtgttacccaaagtgaacgctttaagatcggttgccagtgcctttgctgtgcttgtgtcacgacgatccccgggaatcgcagagtttagatccgtctcgaatcgatccgctttcgttacatgatccccaatctgtttcagtgatttttcgaaacctttagggccgccaagctgctgcagcaataggttccccgcagtattatcgctgtaacggacagcggcttctgagatttctttcaggctcatgcctgtatccaggtgtttttctgtgattggagaatatgtaactaaatcgtctttgctgtagcggatgatggcattaagtttttcatttgagcttttcttcagaacagcagctgcagccagaactttataggttgatgcgtaagcaaaccgttcattcggccgataggcgattgtcttgtttgaccccgtatcaatcgcataaaccccaagcctggcatcaaattttttctcaagctgaacaaatttttgattcgttatacagcttgtcatttttgtgttttctatggattttgcttcagcgtgcgtagagccgaataaagggctgaaaccggtaaagcttaaacataaaagcccaatgcatattccaacttgtattcccgctttatttttcacatccagacctcctcattataatgtttttgtatacatcttctaattaacattacaaacaggatgaaagtcaatatatttcctgtgaatgattaaatcctgcattctgattcctccccttattaaatgcgccgcccttgccgcgtctgaatgtttgcatgtccgcttcgtgttcattatctatttgttatccctccgtgcaaataaaaacggacaccaatcagagcatagtgagctgtgcaatgatcagtgtccgcaggctttccgtcttggatctatatatgtttctcttgcagactataaaaatcataaggtaagttaacaaacgcattaccttaatctcgcggtcaaaattatatcattttatatatttcaataagattattatctggatctctgaaatgagcaactcgtgcacgccattcctgacgatcatgtggttcattgacgcatgtaatcccttgcttgtgcaaatagtcatacgttttatcaacatcttctaccttaaattgaagcaaaaatctcgattgcgaatctccgtctaaagattttctttcttctccaactatttcagccatattttcttgagataaaagctctattttcgtttctccattatcgaaaagtgcatattccatttccttctctaaccaacttattggaagtcctaatgaatctttataaaactcgacgctttttttaaagtcattaaccaatagtctaatttgcagcagtttcatattgaacgcctcctatcattttactggccattcatttaatcatacaatagggacctgacagcattatgtcaagtttccacaaaaaaatttcccatactgcacccaaatttcggatggaaagccttcgaagattcatgaaactgcgtttgatcaattcacattcttagtttgaattctcctcctctccaccgtggaggctccggccgtgtaagtcgcgcacccgtaaacatccggcccccgctcccataagtaacacaactgataaataattgactgagtcgttttttcaccgtcatcgcttcccctgttttttatattctgcgatttccttaggggtagccttccggactccgtctgtgtctgtcctgtttgccacttgagcgccttccatgttttttatctcgctgacgactcccaaatgctctaaatacacatgatcaccaatcttgaaacgattcagtttggcccgctcctcggtcatgctcctgtattcagtcgcggctttcatttttaattcagccagacacatttgacaaagtgttactgttacagaattgccgttaaaatcagtaaacgaaaccgatctgacagattccttttccgggtgcatcgtacatgttttcttcataggtgaaggccgtgtaaatttaatcattccgcttcctcctcaaaaaagtcttttcgtccctctgacataactcggatgaatgggaagttccgtacccccgcattcgaactgtcacaacacatggagattgcctttccttcgccgtctgacggattttcatccatcctgcatagctgtaagcctatattcctttatattcccaatgcccgccgcacttccctgttatgatgaagtttttaaagctattgaccagttgcccaggttgattccatgcggaaagcagtttgggccgccgtatcctaattcattcgggtaaatttcagccctctaatatgtgtgtgtatgctttttaaaggaagtgcgtcacatgatgttctaacaaccgattcaacctaaagctaactctaccccaattcccgatcataaaataagtaaatttacccagaacaaattaatcattttgcactttcaaaatacttatttggcttttccttcattcttccatggtaatatcttgttgaagtatttcgcatgaaaggatatggtcatgaaagttttcgaagcaaccaccctcctcgccgccgccaaacagcgtgcgggtgaatataaaaaactgcgcggtcagatggtcaacctaaaaaaagcgtttcaaggtatggctgatcttggtgacaatgatttctcaggccggggcgctgacaatatcaaagcctttttccaggatcacgccggcgtcacagacagctggcttgatctgatcgatatgaaaatcgcatttctcacaagccttcccggcaaagtcgaagacgcaggtctttccgaatctcatgtagaagaatcttttctggagcacgagctcacccatgccctcagtaaatcaaaggcgattatggaagcgcagaaaaaagacatgcgctccatcctcggtgagatcgaagacatcatctcgctcgaattgttttcaaccgaaagcacagatcaaaagctttcttcagctgacaaaaaaagaagcgaaaccatacataaactcggcaagcttgatcacgatctaacgaaagaatacgcagaaaccgaagcgaacgaacagtttatccaagccgactttcagcagctccaaaacgccacaggcaaaggaaaaagcgccacgccgcttcactacaacgccaaagcgtaccgtgaaagcgacatccataagaaaaaaggcgatatcgcaagacattcggatgcttatttgacgattaaaaaggaagaagcgaaagagcgtgaaatcaaggatctgaagaaaaagctggctgatggtgtcaccgatccggatgagtatttggaaatcgcaaagaagatcggctatgaaaaccttgaacccgctcaggtggaatatgtaatgcagcttgaacaagcaaaacagcttgaagaagtcggagaaacggcttgggatatcgtcaaaggaataggcgtcggcctttatgatgtgggaaaagacaccataaccggcgtcaaagatctggctgtcggcgcatgggatttttaccatctctccgatgaacaaaaagtcgctaaaaccatatcggctgtattgaacacgccctcctacgcaaaaatcatatggacaaacctggcggattcgtggaatgataaaatggttaacggggatgcgtattcaagatcccattacatcacttacgccatcgggagcatcgtcgggctcaaaggttccggctcagctgtaaaagtatcaagcaagctcgcgaaaacaggcgccgccaaagtggataacgtcttggaagccggtgaaaaagcagctgcaaaacatgtaaaaaccgggattgaaaaaggaaaaaattatatcaattccgtttcgaaaaataagtaccaacccgcgcttgccggaatagcacaggatattgaaaatactcacaatgtgaagaatactcctttgttgaaaagtattattgaagatcagaaagagagtgtgctcagtaaatctgtgacttctgacaataacggcatacatagtgttaaacaaggagacagcagtcctctcgcaccaggcggtggcttagctgctcacgaagcaaaaggcggacaccttctagaaaggcatgttgggaagactgatgaagagttattacagaggctacagataaacaagaagatacgtgcctcttctagtttcactgataggccaactgcagaaagagtcgctaatgaaacattaactaaacataaaaaggaaattgaagagtggttaaaaagtgatgttaacgatccattaccgttaccttatagaggaaccgaagttataggtagaggagttcgtaaaggttcaaatgaagttaaagatatgactaatgctagaatagtattaaagaaaaataaagatggtagctttatactaacaggctacccaacgaggtgatatataatgattgaaattaaagtttctgatcctgtatttagatttctcggcggacattttcaccaagatatagagtctccggaaaatgcacttgatgaatatttaaatgaagcatcacaaaaactaaaagaaagagatttaatagcactaactgagtttgtaaatagtgattattcagaagaagacaagaatgaatttatagaggaagcagcggatggtatatactttcctgaagatgatataactccattagaatggcttaagcaagtcactgaacaaattaaaaagcatcttaaacaacatagttagaaaaagagccctcttttaagaagggcttcttttattaattcaatttcgctttcgtttttggtccgcaaattccgtctggcttcaaaccatacatgagctgaatcgtactgaatcgttcagccgcatttactgatgtaagtgaatttaaataaattgcaaaaaaaccctcctcatcttgagaagggctctgacttatacttctttttctctaaatcagtccgaagcaaaaaactgatgccgctcaacttttcaatcgaagtgcttcagcgggttctccaactatttgcccctatgcttttcttttgctttttgttttctgattaaatattcttgttcctttattttttctctttgttttttcttttcttttttcaagctcctgttttattgcattttgcgccttagttgatatcccgatatttttcatctctttagaagcttgtcattgcaatctttttggatttaatttcttagattttgctttaacacaaccccttcttgttcagtgtgggagagagtctgtaaaaaaggaaagagtctccgcttattttaacaacacttcaagttttgctttggttcaagcgcataaattccatcagcttttaatccattcaccaattgaaatcgaattactgcattcgctgttttcgctccatatgctccatcaatcccgaagttcttccgctttaataaagggccgacagcgccgttcgaatctgttttacgctctcccctcgggttttaatgggcttttgacttaaaaaaccggaaagcaaggggaagtatgatttcttgccttaggatggagggccccctgtatcacttctttatcatcgacggcaaaatgatatctagtcgattcactgctaccggtcatataactgatttcattagcggctgcatgcgtcatttcctgtgctgtgaatgatttccagattttcgctgtatttttcatacaaaactaaatattccgtttttcaaatacaaaaaaacagcaggattaaccagctgctgatcgttatcactttagccgttcagtgatacggaatttctgtatttctctgtaatgaacaggtttcggcaaagaccgccgccttaaaggcgatgttcacctcccttgaagtatacagcgaatgtacttcaaaatcggcccaaaaaagcagttccgtccccaattcgtccccaactcgatgaatgatgacaaaatcaataaataagcaaagtaaaaaacccttgcaacgcaagggttttggctatgattccgactgggctcgaaccagcgacctctaccctgtcaaggtagcgctctcccagctgagctacggaatcatgatatgtatgtgttgctgggtatgttgttgtctctctgacatttataattatatatcctgatttctcattcgtcaacactttttttatctaaaataaaaaagggcgcgtcgcaaaattgacggcacccttttcgtttatgatctcacttgggcgggggttatttttttcaatgcctgttcgaagtcgcgttctaaatcttcggcgttttcgactccgacgctcaggcgcagaaggccgtctgtgatgccgcgtttttccctctctgatttcggcatggcggcatgcgacatggctgcagggtatgagagaatggactcgacagcgccgaggctgacggcaaataccggaagcgatacgttttcgaccagctttttgacggcttctttgctttccaattcaaaggacaggacggcgcccgctccgctcgcttgacgtttatgggtatcggctcccgggtgtccggcaaggccgggatagtaaacgtttttgattgcgggatgcccgtcaaaataggcagccagccgctcagccgtccggctcgctttttccagtctgacctgcaatgtttttaagcctctcaatacgagccagcagtcctgaacaccgagcaccgctccaaacgagttttgcagcttatacagctgattgccgagctcttcatcttttacggcggcaaggcctgacagcacgtcactgtggccgcttaaaaatttcgtcgcgctgtgaagcacgatatctacaccgagatcaagcggacgctgcagagcaggcgtcatgaatgtattgtcaaggtatgtcagacagccgtgttcctttgccagtttgacgacgcccttaatatccgtgatgccgagcgtcgggtttgacggtgtttccatataaatggctttcgtgttcggccggatggcgcaggcgaccgcttctgtgtccgtcatatcgacaaaggtatgttcgattccgaaacgggacagaacctcagtcaccatgcggaatgttccgccgtacacatcctccgtgacgagaacatggtcgccttgggataagagcagaaacgccgtcgaaatcgccgccataccggagctgaaagcaaaacctctcgttccgccttcaagacctgcgatcgtttcttcaagcgctgttcttgtcggtgtgcctgatcggctgtagtcatatgtcccgaattcttcaaatgaagactgatggaatgtggaagcatgctggatcgggacgctgacggctccggtggctccgtctgttttaaatggattgtgcacgagctgggtttccagcgtccaattgtgattactcatatgacacggccccctcttttacttgctgtaatgcctgctttacatcccgcttcaaatcttctgcatgttcaatgcccactgaaaaacgcagcagacggttgcagacgccgtttgcgatacggatatcttccggaatgtccatgtgcgtctgtgtcgcggggtatgtaataaaactttccaccccgccgagactttctgcgaaacagatcgttttcagcgcctttaaaaacggattgacccattcttctttttgcagccggaaagacagcattccgccttttccgggatataacacgtcggcgatttcctcttcctgttctaaaaattctgcaagttcaagggcgttttcttcatgacggcgcattctgagtccgagtgttttcatccctctcattaaaagccacgaatcaaacggcgggagaacggcgccgatcgcattttggtgattaaacatgatgtcgccgagctcttcatccttaacgacagccagaccggcaaggaggtcattgtgccccgctaaatattttgtggcgctgtgaatgacgatgtccgctcccagttcaagcggacgctggatgaccggggtataaaacgtattatccacaatcaaaagcaggccggcttctttcgtaatccgggcgattttttcaatgtccgcctcctgcattaacgggtttgtcggtgtttcaacaaatagcgctttcgtgttttccgttattttggagcgtaaacagtcttcatcgctgaaatcatcgtaaataaagcttaagccgtattttctccattcgttttcaaacaaacggtacgtgcctccatataaatcggaggatacaatcaattcatccccgcttttaaataaagccataatggtttgaatggctgccattcccgagctgaaagcaaatcctctcgcaccgttttccaacacggcgatggcgtcttcgacgagctggcgtgtcgggtttttcgtgcgcacgtaatcaaaacctgtagattctcctattcctctatggcggtaagcggtggacagataaatcggcggactgaccgttcccgttgcttcttcgcttctatttccgatttgggctaattttgtttcaacatgctgcgtcatcagtaagcaccatcctttttcaaaaataaaaaagccccctcttcataagaagaaggagcttttctcttcctcttatcttccaagcgtgaatcgcttgctggatttagcaccttggcactttgccttcccgcggcaaagcaaaccggttgctgaggtttcaaagggccagtccctccacctctcgtgataagaatattgttttgtattttctgattgttctatattaacgcactataaaatagatttcaacaactttttatttatctgaactctcgcaagaagtgcatctgaagaaagaaatttctaataattcatggtacaataggaaaaaaccatcaagacaagaagcggcctggaggaatgcgaagtggcatcaaaaaacggaatcattcatgagaaaacacttttctcccatgagcttgaagaggaaatgaccgttttggtctacctgcccgccaccttctcccccctgtataaatatcatacggtcatcgctcaggacggccatgattatttcagattagggagaatcgggcgtcaggcggaagagcttatgtcaaaaggggaaattgaccgctgcatcattatcggcgtcccttataaaaatgtgcgggagcgaagaaacacataccatccagaaggctctaagttcgcctcatataagcggtttatcgccaatgagctcgttccttttatcgacaaagaatacccgacttatcaagtcggatacggccgcaccatgatcggggattccctcggcggaaccgtttcgctcatgacggcgattgactatccgaatatgtttggaaacgtcatcatgcagtctccgtatgttgacgggcacgtgctggatgccgtccggcagtcggaggatctcaaacagatttccgtttatcatcaaatcggagaaaaagaaaccggcgttcacacgacggacggccaggttcttgatttcaccgcgccgaacgaagagctcaaacagctgctggaaagcaaacagtctgaatacacgtatgaaaccttcgacggggatcataaatggacctactggcagccgctcatcacgccggcgctgaaaaaaatgctgtaaccattcatttaaggagggaactttcatgaaatacggtattgttttatttccatcaaaaaaattacaggatctcgcaaattcgtaccggaaacgctacgacccgagctacgcgctcattccgccgcatctgacggtaagagatccgtttgaagcgacagaacaggaaatcgagcaggtcgtatcacagctgagacagacggcgaaagagtcgcatccgctcgttctgaaaatcacaaaatacagctcgttttctcctgtgaataatgtgatatatatgaaagcagagccgacggaggaattaaaatctctgagtgagaaatgctactcaggagcattatccggcgagccggaatacagcttcgttccgcatgtcacggtcggccagaagctgtcgtcagatgaacattccgacgtactcggacagctgaaaatgcaagacatttcccacgaagaagtcatcgaccgttttcacctgctctatcagctggataacggctcatggactgtgtacgaaacatttttattaggcggaggagaataactgcttggaatccatcatcgtaaaaactgaaaaacagctgaacgacgcttttttcgtcagaaaagaggtctttgttaaagaacagcacgttccggaagaagaagagattgatcaattcgaagacacgtcagagcatatagtcatatatgacggcggccagccggtcggagccggcagatggcgcttgaaagacgggcatggaaaattagagcgcatctgcgtaatgaaaagccatcgttctttaggcgtcggagccatcataatgcaggcgcttgaaaaagcggcggcagccaagggcgccggcagctttatcttacatgcgcagacgcaggcggtcccgttttacgaaaaacaaggataccgcgtcacatccggcgaagaatttctcgatgcgggcatcccccatctggaaatgataaaggaatacaaacaataaaaacaaaagcactcctgttgatatggcaggagtgctttttttatgaaaacaataccgtttcatgaattttattgcattttatggaaggttaatgtatgtttagtatacgaagtattacaattcatacaaaaaatacaattcatatttcggagggataaacatgacggcaccaaaaggaaaacacatattcgggactgttaaagtgggcacaaaaggacagattgtcattcctaaagaagcaagagatgttttcgatataaatccgggggattcactgcttatgcttggggatgaccagcaaggtatcgcacttgttaaacaagaactctttttcgagtttgcaaaagatattttaaacgctaagcaaatcgacgcagatagcgaggatgagtaaatgcacgcgattgagctgaagcaattaacgaaacattataaagaaaccgccgccgttgaccgtcttgagttctcagttgagaaaggggaatttttcgctttactcggtgagaacggagccggaaaaacgacattaatcaatatgctttgcggactcctttctccggatgaaggtgatgcatcagtgcttggacacagtatttcgactgatttggataaaataaaaccgaaattgaatatgtccccgcaggaaacagccatcgctcctcatctaaccgtacgggaaaacttagagtttatagccggagtctacggaattccgaaaaaagaagcaaaaaaaagaacagatgagatgctcgaattgtttcaattaaaagagaaagaaagagcaaaaaccaaaaccttatcaggaggaatgcagcgccgcctcagcatcgcaatgggcatgattacgaaaccggatatttatttcttagatgagccgacattagggctggacgtccgttcacgccgcgagttgtggaaaaatcttgagacattaaagggagacatgacgattattttaacgacacactatttagaagaggctgaagcactggcagaccgtatttgcattttagaaaatgggacattaaaagcactgggcacggcggaggatctgaaaaaacaaactcattcagccacatttgaagatgcctttttagcgatttgtgacggagaggcgggtctttatgcttgatttcgccattcgcaaccgcaaagagatttttcgtgatcccttatctatcatccttggaatcgcactgcctgttattctattgtttctgtttacggcgattgaaaaaaatgcgccgcttgatacctttaaaattcagcatttagcacccggactcattgttttcggtttcgctttccttacgatgttctctgcattgctgatcgcaaaagacaaacagaccgcccttttgacccgtttgtttgcttcccctttaaaaacagccgattatgtcatcggttacgcactgccgatgcttccgttagccattttacaaatcgtcatttgttttatcgcagctgctgctgccggtttatccgccgagtggatgaatcttctcgcaggtatcgctgtcttgctgccgattgcgatgatgtccgttttcttcggtttatgtttaggggctgtgtttacggacaaacaaatttcaggtatcggaacgatttatattacactcgtgcaatttctgggcggggcttggatggaggtgagcctgctcggtgacacattcaaacatatcgcttatgccttaccgtttatccactcgatcgagctggctcaggaagtcatatccggagattattcttcctttcatcagcatatttggccgatagcgggatataccgttttggcgcttgcacttgctttcctcagttttataaaaatcaggaagagttaaaaaagccggcactccgtaatgggagcgccggtcttcttttttacgtttctttcagaaggcttatcgtatgcggcagcagacggtcatcccccggactgccatggcccggaacgacaatgctgatgtcctgatatcttttcatgactttgcggacggcgcgcggccactgatccggataaaagcccggagttggtatgatttcctttgtttctaaagccttgattaagcaaccgccgaataagagcttatcctcaggcagccagacggtaatattgtcttccgtatgcccttttcccggataaaacgtttcaattttcatatcgccaaactgcagctttgtcacgtttttcaaatctccgagcggccggtcatatccctgctgccgggcgaagtcggcggtcagcttcgtgctgtgcacctttacaccgtatttgtacagtgtgttcagcccgccgatgcgatcgtcatgggcgtgtgtcacaatggcatcggtcatccttttgccgggaaaccgctgttttatttgtgtcattaattgctctgtgagactgtcattccacggagtatcaatcagtacgattcctttggaagtttcaagaagcaatccgttcgcagggacgggacttccgtctgccgtaccgatgcttgtatgcatccagacatgcggcgccagctgtgtgagagtgacatcttttgctgcggagctctccgccgcgtgtgccggtttcattccggcagtaaagaggccgaatagaaataaccccgcaattaataatgaaagctttctcaaattgaatcattcctttccgcatctttcatatatacggctcaaaaaaacccggagatttccgggctttttcacacatattgatttatcaaccggccttttcccataatttgcggcagacgggaaagagagcgcttacgtttttcctcatgcattttcttttctgcggctgcggtgttttcctggcggcgctccacctctctgtacaccctgtcattggcgagggcggccgctttcgtaatgccggcgtaatcaggcttataacccgctgcccggtttgcgtattgagaatactgctggttttgaatccgtcctgcataaatcatatgtacccctccccttcgcttttcatttcccttaatcttactttttgaaacgcggttcttttgttatgatattctttgtctatcaaatggatgaacaccttttaatgggaggacccctttttgaaatgcgcccgactgaataaccgaacgatacatttacatacatattctagagaacattaccaattcctttttgaagaagctcagaaaggaaatattttttgcgcacattgtgaccagcctgtcttgatgcggctttcgattttagagcagccggcattttatcaccggcaaaagggagacttcaccgcctgtgaaaaagcatgcgccgccgaggaaccacaagcggagaaagaaaaagaagagtataaggaggcaggcatgttccgcctgccgaaaggaaaagcgatttcagagaatccgaaaccgatcgtctcagaatggaaaagcccgaaaaaagtgcctgcggccgaaccgttttcaccaacatccgaggcagctgatacatctttgttccccggcatcggcctgaaccgcgaacagatgcgggcagtcacggaaacggacggccccctgctggtgcttgccggagcgggaagcggaaaaacaagggtgctgacagcccgcgccgcccatatgattgaacacctcggcatttcacctgagaatatgctgcttgtgacctttacgacaaaagccgtcgccgaaatgaaagagcggatggcgaatgagtacgggctggcagccggaaaagtctcccgtctcgtgaccggaacattccacagttttttctataaaatactctatcattatgattcttcaaaatggaacggcagccagcttttaaaaatggagtggcaaaaagagcaatatgtgaaaaaggcgctctatgaagaaaatttggatgaaaaagagtttcccgtcgaccaggcgctgcagcttatcggctgctggaaaaacacgtatctcccccatgagaccattccgcttgcggacgactgggagaaaaaagtgtaccggctctacgaacattacgaacggcagaagcgggaaaaacggcaatttgattttgatgacatggcccaaggctgttatgaactgtttcaaagccggcctgatattctcgcgcagtaccaaaacagattttctcatattttgattgatgagtttcaagatattaatcctgtccagtacaacattatgcaaatgatcgcaagcccggagaataacctgtgctgcgtgggtgatgacgaccaatccatttatgcgttccgcggcagcagcccgtctttcattcttgattttcaaaaggattatccggcagcaaagaccatttacttaacggcaaattaccgctcgccgcatccgatcgtctcaagcgctcatgccgtcgtaaagaaaaataaaaaacggtatgaaaaaacactttctgccgtcaaagacggcgttcacaatcccgtgatgttttatccttacgatgaagaagaagaagcgaccatgatcgtttcggatatgaaagagaaaattcaaaacggggcgagtcctgatgattttgccgtgctttaccggacaaacagcgccggacgggccatttatgaaagactgcaccaatcatcgattccttatcatgccgaccgtggcgtgcagacgttctacagccgcagaatcgtacgccagatcctcgcctacttatatgcgagtcagaatgaagatgatacggatgcggtgaaagatctgctgcccgccttatttttaaagcaatccgccctgcaaacgttaaaggcgctgtcaatcacggaagattgcacgatgattaaggcactgacgaaactgcctgacctgaagccttttcaaataggaaagatcaagcagatcgttccgtttttcgcaagcatccggacaatgaagcccgttgaagccatcacctttgcagaaagcaaaatgggtttttccgagtatttaaaaaaacggggcaatgagggaaacaaactggaaaaaggctctgatgatctcagggatgtcaaagtggccgccaaaaaattcaaaaccattcccgattttcttgcgcatgtcgatcatatgcgcgccgctgagaatcagaaaaccgatgaaaacggcgtcgaactgctgaccattcaccgctctaaaggtcttgaattcaatacagtctatattttaggcgcggctgacggctcgataccccatgacttcgcgcttgagacagcgagacagggcgatcccgctccgctcgaagaagaaagacggctcctgtatgtcgccatgacaagggccatgcagcatttatatgtatcttgtcccgcgtacaggcggggaaaaacagcgcgcagctcaagatttctcgagccccttcttcggacggacagacggagcgcactcaggatataaagaacccggcagatcactgccgggttcttctcacataaaaaggcctttttagcaaggccggctgacgcctatttattgtttaacattttagaaatggtgccaaaatcaagtttctctttaccgcttgtaatcgattgaacgattttgtcttccaattctttcggaacacgcttgttagccagctgggacaccttctgaatgacgcctctcaccgtgttttcatctttgaaattggcattttgcaatgatcctgcaaggttcatgacatccttcatgctgacgcctgttttcttctcaatatttttaaaaaattgattatccatggtgtgcctccttttgtggagtaatacgatattgtatgaataaagggcggaacgtgtgcccgtaagacaaggaaaaaattccgcatctccttctctatccttcatacattagggaagcacgggactgaacggtcccgcgcttatccaaagtcttgctaaggtttagccaaaaaaggatgcaccgacaatgatcagaaggatgaacaatacgacaacaagaacaaatgttgagccgtatccgcctccgacatagccgcctccgtatccgcagccgccgccgcagccgtaaccgccgtagccgccgccgaatccgccatatccgaatcccatatttaagcacctcctttactctctatactctatgtgagccgacttgtttggcttggataaatgcatagggccggtgcggatttcttttcattttattgagaatgctcatttttcttcagtttcgcttctgtttcggcggcaaacacatctatccattcctcaaagcgcgctcccgcttcatcaaactcagacagctgtttttcaatagataagatatagttgtcatgctcccgctgattttgattgtgccggcggtatttaccgtttatgaatgattcaaatatattcataacatcccctcctcctatgatctatgccgggcagaggccggcgttcggcaaaaaacaaaaaaaccggaagctccggttttttttgaaaacggctatttcggttttttcttttggccgcagccgcagccttttttcttaatttttttttcgtaaggctgatgcacagttgatttgtatggagagtgttgggaaggtttgcttgattgattcatggtgatccttcctttccttatgtcatatatgccagtttatgccgaaagtgacggtaagttgctggtggaaccgccttattcctgcagaagacgagaaaccgcagcttcaatgatcccggccgcgccggctatggctaacagcaaaatcagccattgcgcagcctcggggatcacaatctgcgccgcaattaaaaaggcggcgcaccatacgcccgtacaccaatagcagctgagaagttcaccgataaatgccctgatgccttttccttttatgacaatgtaggtttctgtcgtgccgtcgggtgcggtttctgttttttcctcgtgaaaaaggctccgaagcggcgccataatggtgtcaaatacgaaaagcctggccagccggaaaacggcaaacgataacagaataaatgaaagccaattgataaccacctgttcactccttttcaaaacttgacctctttatacatatgcgaaaaccctgatcttcatgaatcgcaccttgtccggtaaaaaaataggtgcggtttagttgtttttcttattccgctcggcgtttcatttgcattatatagagtatgaatgagaaaggagtgaaggttatgtcgtttgaagaaaaagtcgaaacactgcaaccgcaaatatacgaacaattatccaacgaattcgagcagacgatcgaagtgattgattgcgaaaatgtcacaatagatacaacacatataacggccgctctttctatacaagcctcagttactacggcgattatcctcgcgacacagctcgcgatcgcagatgaagacacagccgaccaaatcgcaaccgaactgctgatcctggatgattgccaaataaaaaagaggaccgtcattcaagtcctgaacagccgcaatattaaaatcacactgacagcagacgatatcatggcctttgtacaaattttgtttcaattattaaatatactttttgctgaactagacatcctttaacctttcttttcaaatatttaaatagaggtgagaacaaatggcagataacgaaaaattaaaaaaagaactcgaaaatctaccagaagtggatccgcttttaaaggtgcttgtcagcaatgtcttcaaaaaacacggcgtgacaaaggataaaatgcgggaaatccctgatgaagaaaaagaaatgctgatcgcattagtcaaagacatgcaggcgaaaacagaagcttttcttgaaagccagaaacagaaaaaagagcaggaaaaagcgcaagaacagcagacaaatccgcaaacccgcagagaacaattaatcgaacagctccggcaaagacgccaaaatcccggtcaataactaaaaaatagtgatttttatcaggatagatgcctgagtcaaaataaggggccggctcatttaataatagtaaaagaaaaggaggaatagatatggaaagcagaccatactcttgggttgcacttgatcctgaatgcgaacatccgcgagaagaaaaagaagaaaaagaaggaagaagatgcagtgtttgctgtaacggacatggatttggcgaagataatgccttccttgaccaagacctggctcaggcgaatatcaacaaacaagtttctgaagaagcgattattatcagagactcttgtgatattaacgtaacgtcaacagacgttcaagcagtcgcttcagtcatgacagcgattaatgcagcagtcgtaacggccactctcacttcaattgctgacggagtcatcgctgaattggtcgcacaagacttattgcagctaacagctaacaaacaaatcaaccgtcaaaaattgctcatcgaaaactcccgcggcgtaaacgtgacaacagtagatgccgatatcgcagtgttgatctcaacagcgacaaatttactgattgccgtcttagtcatcacccttgtcctctaaaaagaaaaagcagagctaaaaatgctctgctttttcttattttctccgcatatgatgaatatatagacgttcacccacaccaagtgaggctcgcgtacatatgttgttaaagacaaaagtcaaataccctaaaagaaggagctgaaatccatgagctgcggaaaacaccatggccgagatgaaagttgtgtatgcgatgcagtcgagaagattttagcagaacaagaggctgttgaagaacaatgcccgactggatgctataccaatctgttaagcccgacggttaccggtaaagataccatcccgtttctcttgtttgataaaaaaggcggtttgttctccacattcgggaacgtcggaggatttgcggatgacagccagtgcttcgagtctattttcttccgggcagaaagagtttgtgattgctgcgcaacgctttcagtattgcgccccgtagatgtgcacggcgacaccctcagcgtctgccatccttgtgacccggatttcttcggtttagaaaaaacagatttttgcattgaagttgatctgagctgcttcagcgccattcaatgcctttcaccggagcttgttgaccggcctgagccgcacaaagagaaaaagcatcacggatagtcattgattcgcatctttcctaaagaagaatccccttccaaccttctattacagatgcaatcatcagcccgcccggacttccgggcggctgactctccgatatcgtttaatccggtatataaaacgtgaagtcaggagggatattatgagcaagcatacaacatactgtgtgcgtgaagcggtagaaaatattgaagacctgcaaaatgcggtcgaggaagattgcccggccggatgctattccaaccttttatcgccgggtttttcattaggcgatacagtgccgtttgtacttttcacttctaaatcatcaccgtttaccgcattcggaaatgtcggcgagctggataacggtccgtgttttaacaccgtttttttcagagttgaaagggtctgtgacggctgtgccacattaagcctgcttattgcttttgacgagcataagcacattcttgattttacagataaagactctctctgcgatgtattccgtttagaaaaaacgaactattgcgttgaagtcgatctccatagcttctgcgccatcaattgcctgaacccgagactgatcaaccgcacacattcttaaatcaaaaagcataaaaataagctgccggattaaagaattcaggcagctttttgtatggttaaaatccaagcggatgcagcgaggtaatatcgtctattgcgagttctgccggcgctccgttgcttgtcgtccgcaggaagatcgcattattttttcttccgacgattacgcctctgtaggttttcccgttggcttctatcagacaaagggtccgcggcatattatgcggcagcttcgttaagaaatcaattttttcaagaatggacattctgctcatcggctttttcacgcgctttggcgggaccttttcctctggggcggcattgtgaaccgcttcaggctctttttcagcggcttcaggctcttttttagcggcttcaggcttggcagtgtcctgctccgcttgcgccggaacttcttgaacggcttcttctgagcggctgtgctgttcaggtacttgcttttctggttcgacagccactgctccttcaggctgagttttacattcttcctcccgctttccatgcatcggctcttcttccggcggctgcggcgctttcctttttttgattaatatgtcctgcattgatgattgcgtgtctgaataatccgcctgaacaatatacatgagcggttttttttccgcgtttctgttttgttttgacatcttcatccctccgattctgtcatgttttatttatatgacggaatgattaaaatcagaagaaagaaaaaagcaatccctgaaagggactgcttgttatttaacgtgcggtaatatggaatcctgaatccacgtgaagattttcgcccgtgatgcctcttgacaggtcactgaacaagaatgcagccgtgtcgcccacttcttcaggtgttgtcgtgcggcgcagcggcgcgcgctcttcaatttctttcaggatagagttgaaatcactgattccttttgcagacagcgtacggatcggccctgctgaaatgctgttgacgcggatgttttcttttcctaagtcagcggctaaatatctcacgctcgcatcaagagacgcttttgccacacccattacgttatagtttgaaacgacgcgctctccgccgaggtaagtgagtgtaacgatgcttccgccttcagtcataatcggacgcgccgcttttgcgaccgctgtcagagagtaagaactgatgttatgcgcaagcaggaatccttcgcggttcgtatttaaatattcgccgacaagctcttctttgtttgcgaacgcgatgcagtgcgcgatgccgtgaatcacgccgacctgctctttaatgcttgcaaagcaagtttcgatctcagcgtcatttgtcacatcacacggaaggatgatggaatcatttctttctaatgtagccgcaaggtcatgaactgatttttccaagcgctctcccgcgtaagtgaaaatgaggcgcgctccggcttcatgcagcgaacgggcgattccccatgcgatactgcgtttattggcaacgcccatcacaacgatgttgcggccttcaagtgagaaattcatatgtataaagcctcctgtaatcgtcttaaagacatagttttagtacctgatcttaatttttatcatatcataaccttgtccagattgaaagcatgggaaaaagaccgcggatgttgaagcggtctcttttttatctcgtctgcagactgttccttttaaaggcaaaatgattggtcgggccgtgtcccgctccgatgccgagtgtatgttccacggcttcccgcacaaaattgacagctgtctcaaacgcggtctgaatgtttttcccctttgccgtttctgccgtcagcgcggctgcgaacgtgcagcctgttccgtgggtgtgtttcgtgtcaatataagcgtggctgatttgggtaaaagacgaaccgtcaaataataaatcaacgattctcccctgttcaggctgatgtccgccttttatgatgacatgctttgccccaagcttgcaaaggcgttcggccgcttttttccggtcctcaaacgtgcggatttccatccccgtcaatacctcagcttccggaacattcggcgtcaccgcatagctgcgcggaattaacagctcttttaacgcggcctgagattcctcacgcagcagggaagcgcctcctttggcaatcatgacgggatcggtgatgagatgatcaagcccgtactgatccgttttttccgcaatttccgcaatcatttccgcgctccacagcattcctgtttttacagcatcaggccgcaaatcttccgccaccgcgtcaatctggctgcccagcgcctcccgggtgagcggataaatgccgtgaacgcccaacgtgttctgggcggttaccgctgtaagggctgacatcccgaaaacgccgagctcctgaaaggttttgagatccgcctgtataccggcgccgcctcctgaatctgatccggcaatcgtcaatgctttgcatatgctcatgatgtttttcgctcctttcacattatccgatccatttatgataaaaagatttcgctctgctgatatcacttgtgccgtgtattaatgctctgccgtcacgaaacagtaccatcttgaaattgtctgtgcaaaatgaaattaaatacgggttggctgaaacatcaagccctgcccgtctgagctgtcccgcaagattttgcagatcaaactgttcggaaatccccgttctgatctgcaccgtgttccgcccgcacagaaccgccgcttttgtctgattttcataggataaaaacggaaaatcgtttgtgccgcagcttgggcaatcagccgacttaagacgggcgacgtttatttctgaccgttcatttttccataaatcaaaggaacggagaacatgctcgatagatccgcccgttaacagcttcagcgcatctgctgcctgaaaaacggccgtctgcaatacagccgggctgatgattcccgccgtatcgcatgtcataccgcctaaaggcaatgtctcaagcagacagtgaaggcacggcgtgacaccgggaatgacggtaaaagagagcccgtagctgccgacacaggcgccgtacagaaagggaattcctttctgcacagccgcatcattcacaatcagcctcgtttcaaagttgtcggcggcatccacgatgagggaggcatcacgaatcaatccgggtgcgttttccgcagtgacatccatgacaaatccctcgacctctacatcgctatttatagaccgaagccgtttttcagccgccgcggctttcggcatttcctgtctgacatcgtcttcggtataaagctgctggcgctggagattactccactccacataatctctgtcagcgatcgttaccttcccgacccctgctctgacaagcatctccgcacttgccgtcccaagcgcacccgcgccgataatcacggcatgagacgaccggagcttctcttggccggtgggaccgatcggctgaaacagctcctgtctggaatatctgtccgtcataccggaagaccgtctcgcggactgcttgcagttccgtaatctttcaccggaattctcccggcttcataagaaagacggcccgcttctacggcaagcttcatcgccctggccattttgaccggatcatctgcgcctgacacagcggtatttaacagcacgccgtcagccccgagctccatcgcgtaggcggcgtcttttgaagatccgacgccggcatcgacaatgaccggcaccttcgcctgttcaatgataaaagaaagattcagcggatttaaaattccctgaccggaaccgatcggcgaagcgcccggcataatggcatgcaccccgagctcctcaagacgtcttgcgagcacgacatcatccgacgtatacggaagcacgataaatccctcttcgagcagctgttctgatgctttcagcgtttcaaccggatcaggcaaaagtgaccggctgcatccgatgacttctacttttatcatgtcacaaagccctgaagctttggcaagccttgcgattcggaccgcctcttcagccgttgcggcgccggccgtattcggcagaagcgtgtatttagacaaatcaagctgttcgagaaagttaggctgagactcttcaaagatgttcatccgccgcaccgcaaaggttaaaatatctgattccgagacggccaccgcctctttctgaatctcaaaactcggatattttcccgttcctaacagcaatcttgaccgaaactgttttccgcctattgttaacatcctcatccgcctcctacaaaatggacaatttctatgacatcgcggtcacacaaacttgtattttcataattctttttttcaatgatttctttatttctctccacaactacgattctttggtcaagctggtacgattcaagcaaatcctgaaccgtcccctcttttcgattccaatcaatttgttttccgttcagctgaaggatcatatatgaacagcctccttgcgatcgattcgaaacgcttcttcccattcctgtttaatctgtctttccatgatcatatcccgcaccatttcagccgttgccggcgccaacaggatgccgttccgaaaatggccggcggcgaagatgatgccgctgtcttcagggtgttgcccgataaacggcttgccgtctcttgttcccggcctgagccccgcccaaaaccggtctattttcatatgttcgatggcgggaagcatggttttcgcttttgcaatgacggcctcaattcctccgatgtcaggcgtatcgctccagtcgccctgtttcatcgtggcgccgatgacaagccggccgctttttctcgggacgacataacaatgatcatggtaaagggttttggtcagcggggtatcgtcattccacacggaaaggcattctcctttcacaggaaaaaaaggctgtcccaagccgagccggctgaaaaaccggccgctccatacaccgcttgcaactgcgactttgtcagcataaacatccccgccggacgttgtgatgcaatattctccgttcacccgttttacggaagtgacttgtgtgtgctcatatatgtcagcgccatagcgccgcgctccttttgcatacgctttgcaaacatagtacggttcgacatggacatcgtcttttataagacttgcgccgagaatgtcttttgaagcgtaaggctctttttcaagggcatcttccgctgaaagccaagtgacggaaggcagatcatccatcttccgtaaacgggcgatatcttcttcggtatacgccagtttaagcattccgccgttatggcgcctgatgtcaatgccgctagcttcctcaagctcttgccccgccgcttcatacagcctttgactgtgcatggcaaaattaaaaaacgcatcccggttttcacattccgcatgagcacccagcattcccgcggcagcgcttgtcgtttttcggccgacttctccggcttcaaacaagacaacgttctgctgcgtcttcgccagctcataagaaatggcacacccgataattccgccgccgatcaccgccgtatcatagtgctgcttcataatcggcctcccttaccgcacgtgcataccgttttgccgcctcctcgggattttcagctgagaaaatgcctgacatgacggcaattccgtccggcttcgcctgctttgtgtgtccgatcgtctgcagtgtcattccgccgattgcgataacggggatggaaagcgtgcgtttgatctctgaaagcaggctgatgcctcttgcttcaagtccttgtttacattcggtttcaaatatatggccgaacaccacataatccgcatcttccttttcagcttggatggcttcttccagcgaatgaaccgaacgtccgatatgaagatggggaaatctgcttcgcacctgctttacggaaaagctgcgggacggaagctgaacacggtgtatgttggcaaaaagcgcgatatccgccctgtcattgatgatcaatttgtccttatccgcaccgccctttttcaaaagggacaaaagctgcatgatctctcccgctgttttatcccgctcacggatatggataaagcttacttcgcgctgaatcgatagaatatcctcggccagctcggcaacgggtttgcgattatcagttaccgcgtgcagctccaaaggattccacctcttttccgtccttctcggaccagccttctttttgataagccattccccaaaattgatattcataatagcttgaaatcacaaaattctctttcattttcgcgcggatttcctctgtgctgttttcagcaatctcgtcaaaacggctgatctgttcttcgacctgctgtctgaaccagtctccgccgtatgtaccgatccatttttcataaatcggatgctccggtttgcactcttttaggtgttcgccgacttcataataaagccaataacaaggcagaagcgcagctaatatttctccaaaattgccgctcatcaccgacctgtacatatgagacgtataagaataggcggtcggtgccggtttaaatgctgcacgctcttcttccgtaattcctaaaagctccgtaaactcgcggtgcagcgccatttccgcttcatatgtcccttgagcgtggcccgccatcctgcccgtcgtaaacaagtcttcggcatatgcggcgccgaacgcctgaacttttgcaaaatgcgtcaaatagtaggaatcttgcagcacgtaatagctgaaacggtctatcggcaggcttccgtcaccgattcccgttacaaacggatgaacaaaacttccgtcccaccattcggcagccgcctgtctgcattcttcagaaaatgtcatcatgtcttcccccctgataaaataaaaaaaccactttcccgcatcggaaaagtggtttggaatttaaatggataaaaggaaccccaaaaaaataccgctccacttccctacgcaggtctgaacctgttcaagttatgagggtctaaaagtctcacttttatctcagcccttatgaaggacacccctagtggtcatacgattaatgatttatttgttatgccttctatattatcacgaattgcaatttggtcaagcttcaaggatttttctcagttctgacacgtagttgcgcgagcctgtgacgatgagacggtctcctgttttcagccgtgtgtctccgtgcggaacgatgctgtccacacctctgaaaatccggacgaaaatcacatcgcccatcagcggaaattcccgcagaatgatgccgttatacgccgggttttccagattgatctgatataacgaagactcctcattcgtcaggaggctcatcacgcccggcgcctcaattaacgcgcgcagcagcgtttttgtagacagaaggatagaaaaaatactgatgccctcttctttcagttttgtttcatgctcaaccgagccgacgcttgcgatgatacgctcagtccctttctctttcgctagtaaggcgatttcagcgttcacatcttcatttcccgtcgccacgacaagaatatccgttttgaaaataccgtgcgactcaagcgtgccgggctcgtaatcagaaatcgtgtcaaccgaaaaaacggattccgcaagcgtttccccggcattttcctgatacacatggacgacccgtacttcatattcctcctcaggcaattccagcgtaaccgggagcgtcatttggttggcgccgataaatgtaatgcgctttttttcctgcggcgcgctttgccgtttgaataatttcttaaagccgatcggcgtgatgatgctggcaataaccgcaactaaagtcagcgcgccggacatattggcgctgataatgtggagcctttctccgatcgtagccgccgcgataacaagcgacagcgtggacgtcagcaaaaagcccgaagcaaacacggttcttttgtcgtaccatttctttaaataaaacaccgggaacattttgctgataaacagcgcaagcagaagcagcggaatcatcgttaatgttttcggatcttggaaaagcgtccaaatatccaatttcaccccgaccatgacgaaaaagatcggaattaaaaacccgtagccgaaggaatccagctgttccaccatttctttattcggagacagaagcgataccagaacgcctgccaaaaacgcgccgagaatattttccgccccgagagattccgataaagcgacaagcacgataatcagtgtgaaaatggctctcgtgccgatctgcacagtgcctttagacatcgactgcacaaatgaacggtgtttaaagatcctgccgaagaaatacagcacgacccccgcggcaaagagaatcaacagaagccacatatttccgctgtcttctccgtaaagagaagagaagaaagcgagcagaatcattgtagccaagtctgcgataacggcgacaagcaggatgatctggccgatattggagttcatgatccgttcttcctttaaagtcgggaccaccacaccgagtgatattgttgaaataataagcgtcattaaaaatgcgttttgaataaaaccggctaatacaaaggcataggacagcagcaatgataaaataaagatgccgaaaaagataatcagcgcggcagaaaacgtgttgggcgcttccttgccgttcggaaggaattgttttttcttccctttctcaaatgaagaaaaatcaatttccaagccgcttaaaaacattaaaaagataaagccgagaacagacagcgtctccagccacgtgtctccctgaacgacaagattcaggccgctttttccgataataagccccatgatgatctccgcgacgacgacggggatgctgagcttaaaccgatgtaaaaggagcggcgtcaaaaaagcgacgatcagaacgacgactaaagatgcgactgatgtgtgttccatttgtaaatacctccttaaaacaagggttataaaagcccgctttaagcggacgaaaccttactttttttaaaaacataacgcatattctaacaaggcttaacgcgaaaaaaaagtgataaggctttatttcttcaattctttttttaatttgtaccaaaacagcgtaattaggtataggaattagccccataataaataaaaaaccgttaataaggaggctgacacgaatggcttatgacatcatcagcgatatacacggatgttatgacgaaatgatcgccttaatgcaaaagctcggatatgaagtgaaagacggaacgcccgtccattctgaaggcaggacgcttgtctttgcaggggatttaacggacagaggcccaaaatccgtagaagtgatgcgttttgtggcaaaagcatatgaaaaaggagccgtccgttatgtcccgggaaatcattgcaacaaactgtatcgttacttaaaaggaaaccctgtaaaagtgatgcacggactggaaacgacggcagccgaactgaaagagctgtctcccgccgacagaacggaagtctccggacaatttatccgattatatgagtcagcgccgctttatgacattttacataatggcgatctcgttgtcgcccacgccggcataaaagctgacgatatcggtaaatactcgcgtaaggtaaaagaatttgttctgtacggcgatattacgggtgaaacgcatcccgacggcagacccgtcagaagagactgggctgccgactatgaaggcaaggcgtgggttgtgtacggccataccccggtaaaacgcccccggatcgtcaaccgtacggtcaacattgatacaggctgtgtcttcggcaatcagctgacaggctttcgttttcccgagcatgaaaccgtctctgtggaaagctctatgccgtatgatgcttcacgatttcgcgaggatcacggcaggcaggcatgaaataaagcccgaaaccggcaaacggttcgggctttacatgtgttcaattaatgttttcatatcgtcaggcaccggagcgtgaaaaacgagcgtttctccggtcatggggtgtacgaatgaaagccgctcactgtgaagagcctgccgggcaattccctcattttttccgccgtacaatgtatcaccgactaacggatggccgaggtagctcatgtgcacccggatttgatgcgtccgccccgtttccagccgcagggctgcaagcgtaaacgcatgtcccgctttttccgtttgaaaatgcgtcaccgctcgttgtccatccggcgttaccatccgctcaataatactgtcgtgttttcttccgatgggcgcgtccaccgttccttccttctgcagcatgatcccgtgtacgacagcgagatatcgcctgctgacaagcccctttttctgtgctgccgacaaaagagaatgggaaagccgatgtttggcgatgagcatcgcccccgatgtgtccctgtcaaggcgggtgacaagatgaaccgttgattgcacgccgctttttcggtagtggctgatcactccgttagcgatgctttttgacgggtgttctcttgatggaattgaggagacatacggctgtttattgaccacaagcacatggtcatcttcataaagaatatcaagcggaaccggctcaggcaaaagcgtttcactcacatgctccttcggaaattcaatcttaagcacgtctccctccgctaacacggtgcggacggttacatgctctccgttcacaagcaggtctcccccgccgaatttaatgtcagcgagaagccgctttgaaatgccgagctgcgccgtatattctttaaccgtcatgccggcatcccgggcagtcatgttcttttggataaaaaagttgtccaatccgtttcctctttctattcgccttttccgataaaggaatcctgcacccttttccaaaacggaaaagggcggaatcttgcaaatctgactttttcatttgccacacggcatagaatggacttgacatccttatgcagcaaggttaaatgatcaattgtgacttgaaagtcgacgtcgtttctcggtttgatgacacagttatgatgatcgggaagcaaaagcggcgagccgacagtcctgaacactctgttgttgatagatgccatttcggcaagctgaatcgccctgatggaagggtggatgattgcaccgcctaacgccttattataagccgtgcttccggaaggcgtggacagacataaaccgtctcccctgaacgtttcaaacagctggcctttaatttccacgtcagcgacgagactgccttctatgcttttgatcgtacattcgttcaaagccagataccgctcctcacgctcttcatcatgataagtgacaatcacctcaagaaggggatactccacggtatgatacggcgttttggcaatggccagaacgagcttttctatctcctgcggaacccaatcggcataaaaacccaaatgccccgtgtgaactccgacaaaagccgttttatcaagacggtcgctgtacctgtgaaatgcgtaaagaagcgttccgtcaccgccgacggaaataacgatttccggctctttttcatccaaggtcatatcaaaatcgagtaaatacgcctgtattttgcttttcagtgtatctgaaacctcgtctccttttgaagaaacggcaaatttcatgccattcccctcctttccttcctactggcggtctcccgcttttttctttcgcgagaacgcggcttgggcttcctggatttctccgcggatttctgacatttcttcatcgagccgggatgcggcttctgaggcccgctgcagcctcagctttactttttcgggaatgttcccgctgtatttgtaattcagtgaatgctcaatggttgcccaaaagttcatggcaagcgtccgaatctgtatctccacaagaacgtgcttttcaccggacgttgtttgtaaaggatataaaacgacaaggtggtaagaccgatatccgctttccttatgctctgctatgtaatcccgcttatcgacaacggtaaaatcttttctggcaaacagcatatttttgacgatctggatatcatcgacaaattggcacataatacgcagccccgcgatatcctgcatcgtttcaatctgatgaagcggtatgctttttcgtctcgctttttcaagtatgctcgccaccggcttcacgcggcctgtcacaaactcaatcggtgagtggtcatcttcatactcataaagggttctgacgcctttcagcttcacctttaattcttcaacagcctggcggtatggcgctagaaattgctcccattgtttgtcatccatcgtacatcccccaattccgaacctgttctaaagaaatacgtttttcactttttcttccatatctccgtagtttgcattatctttaatattttcaagaagataatcgagttcttcatgcagccctgaaagttcaaccgttttcgcgccggcctcaaggaccgccggttttccttggtctaaggcttctttcagatccggccagacatgttcttttataatgacatattcaaaagagtcagctgattcaagtatgtatacaaaagcaaagtgatcggaatcaacaagcatttgacctgaggctttgcgttccgctccgcttaagtcttctccgcacttcaagcggagcgcgtcttctgttaatgatgcattctggatttcaattctcttttgcataatgttctccttttttaacaaagtacagcatttattttatcatatcaaggtcgatattgataaacgtaacctctaaagagataatgggaattatacaatttttcgtcctgaaaggaagactgtcatgacccaagaaatagaaattgaattcaaaaacctgctgacaaaatcagaatttctgaagctgagtgaagcactctgcatgaaagaatatgattttaaacagcaggtcaatcattatttcgacacgaaagatttttccctgaaacaaaaaaaatcagcactccgcatccgagaaaaagacggctcgttcgttctgactttaaaagaacctgccgcggtcggtctgctggaaacgcaccaacagcttgcggcggcaccggatcttgacgtcttcaagattccggatggccccgtcaaacggcagctggacggtctcggaatccgttcagaacacatttgctgcttcggaacgctgtcgaccgcacgcgcggaaaaagaatcagaaaaaggcttaatcattttagatcacagccgatatttagagaaagaagactttgaattggaattcgaggctgctgactgggatgaaggaaaacaggcgtttgaacaattgctcaagcaattcggcatcccagagcggatcacgaaaaataaaatccagcgtttttatgaacagaaacaaaaaaaggtggaatgacacagtgaatataacgaattgggcggcccttctccagctgcagtcaatggcgctgcaatcaatctctcatacaagcacggattcaggcggacaatcttcagaaagcccgcttgccaatttcagcgcgctgctcagccagtatacggacacagccgtccggcagcagccggaatcagggattttaaacggtgtgcggaccgctcacgcttcatattcaccgagaattccggtttcatccggttccgcggcagcttcacagaccgtttccccgagcataaagtctccgaatgcggcttctgacatcagcaccggaaacttttcaatagacagcgccattcagaaagcagccgaaaaatacggagtggacgaaaaactgatccgcgcggttattaaacaggaatcaggctttaatccgaaagcggtcagcggtgcgggggcaatggggctgatgcagctcatgccttccacggcagaatcactcggggtgtcaaacccgcttgatcccgtccagaacgctgagggcggcacaaagtacttaaagcagatgctcacgaaatacgacggaaatgtatctctcgcgttagccgcctacaacgcaggccccggcaacgtagatcggtacggaggcatcccgccgtttaaggaaacacagcaatatgtcaaaaacataacccggcagtattacgcgtaaaccagagaggcttccttcgccctctggtttttttgcggagtgaaatcttacacatgaatgaaggcgatgtgatatgatatgaaatacaagcgcctgacagaaaggcactttgtttgtagaaataaaatgttattgctaaaatatacagtaactgaagatagtaaaactgaaagataaattcgcaatgggaattatgattcctattagccatataaaggagtagtcaacatgggacaatcgtttaacgcaccatatgaagcgattggagaggaacttctatcgcaacttgttgatactttttatgagcgtgtctcgtctcatcccttgctgaagccgatatttccaagtgatttgactgaaacggccagaaaacaaaagcaatttttaacccagtatttgggcggacctcctctttatactgaagagcacggacatcccatgctcagggcaaggcatctcccctttccgattacggatgagagggctgatgcgtggctaagctgtatgagcaaagcgatggatcaggtcgggctggagggcgatattcgtgaatttctgtacgggcgtctggaactgacggccaggcatatggtaaaccagtcagaagcggaggatcgatcatattgacgaattatcagcatgagcaatacttcgcccattgccacggacatccaaaaaaaccgctcgaaatttacatgtttgtcgaccctttatgtcctgaatgctggtcgctggagcccgccataaaaaaattaaaaatcaaatacggacgttttttcaccctgcggatcattgtttccgcgagcattacatcgctgaataagcaaaagcggaaaaaacaccttcttgccgaagcttgggaaaaaattgcgaaccgttccgggatgccctgtgacggaagcctttggcttgagcaggatcagcctcttgcatcgccctaccttgccgcactcgctttaaaagcggccgaactgcagggaagaaaagcgggcattctgtttctccgcagcatgcaggaaagcctgtttgtctccaagcagaatattacggatgaagacgttcttttagaaattgctgaaaagacgaaattggatgttgaagaattcaagcgcgacctccattcgcaaagcgcggtaaaagcgcttcagtgcgatatgaaaatcgcggcggaaatggacgtcaccgtcaacccgacattgacgttctttaacagcctgcatgatgatgaagggctgaaggttcccggcaactattcttatgacgtatacgaagagatcttattcgaaatgctcggggatgaaccgaagccttctgaaacgccgcctttggaatgtttcattgaatatttccggtttgtcgcatcgaaagaaatcgcactcgtttatgatttgagtctagaagaagttgaaaaagaaatgaaaaaactggcattcgccaaaaaggtcgccagagtggaagcaaagcacggtctgttttggaaatctctggccggaacccaggaggatgtcacctgttgtgaccattaaaaaaagctgattccttacggagccggctttttttgtgcaaataaagaaaccgcgccgggataagcgcggtttcatatgtcttaacgacaacaaaggggatgggagaaatttttcacggtcaaacaaaggggtaatgtttgtttgtgatcaatttcacatccttatcatatcaaatcttgtcgagttttgacaagccataagattaatgttcatatttttgtcacaaaacataactgactgcttgttttcatagaatatatcaatcataaacaaggagggaaatcaatgctccgcaccgtattgatcatcggaatgattgtgtttttcttctttttaaacctgctggccatgatgcacatgctgccgatttacattacatctccactgctgtttctgtccatattgtttgccctgtaccggctgaatcaccgaaaaacgtttaaggggttttagaaaaagcctgcgcatttaatgcacaggcttttttgaattacgaagggttcactttcgaaagaagctcttccatttcgttcagtttctcttcaaacattttgcaggccgcctcgatcggttcaggcgatgtcatatcgactcccgcttttttcagtatgtcgatcggatattccgagcttcccgcttttaagaattcggtatagcgctccaccgcaggcttgccttcttttaagatctggctgctcagcgcttgggccgcactgtagcctgtcgcatattgatacacataataattgtaatagaaatgcggaattcttgaccattccagactgatttctttatcaatcaccatgttgtcaccgaaatactttttattcagatcataataaagttcgttcagcagttcaggcgttagcggctcgccttcctgcgctttcgtatgaatcagatgctcaaattcagcgaacatcgtctgtctgaacactgtgcctctgaatccttcaagcatgtggttgagcaggtacagacgctgtttttcatcctttaagctgttcagcatatattcaccgagcagcgcttcattagtcgttgaagcgacttcagcgacaaaaatgctgtagttaccgtacggatacggctgatattttctcgtatagtagctgtgcacggaatggccgaactcgtgaacgagcgtaaacagattattgacattatcatgccagttcatcaagatgtacggattcgtgccgtatgtaccggacgaataagcaccgctgcgttttcctttgttttcgtatacatcgacccagcggttttcaagtccttcttttaaaatagacgcgtattcctcgcccagcggagcaagtcctttgagcatataatctttcgcttcctcatatgttaccttcattcccgaatcttttacaagcggtgtgtacaggtcataaatatggacttcatcaaggccgagcacctttttccgcaggtcaatgtaacggtgtaataacggaagatgtttattgatcgttttgataaggttatcgtaaacctcttcaggaatgctgttattggataaagccgcttcccgtgctgatttatactttttcacacgggcgtaaaaattatctttttttacagtgccgctgagtgtagtcgccatcgtgtttttatactgtccgtatgttttatatacggcttcaaatgcgtttttgcggacttcacgattgctgctttccaggaaattaataaagttgccgtgtgtgatttgagtttccttgccgttttcatctttaatcgacggaaacgtaatatcggcgttatttaaaacactgaatgtattggaaggcgaagacagcgcttcagaggcttccgcaagcagggcctcttcttgttcgctcagcacgtgcggacgctgttttgtaatttcttcaattgcatgggagtaaagcttaagctcctctttttcaagaataaactggtgcagcttgtcctcctgaatcgccagaatttccggttcaatgtaagcagtcgcgctggcagcctgagaatacaggcttgcggctttgtcgttcagcccttggtagaaagaatttcccgtatcctggtctgagcgcatatgtgcgtatgcataaagtttcccaaggcggttcgtcacttcatcctgtgccgtaagcgccgcgtataaattatcagccgaatgagcaagcgtgcctttaaatgaagataaattcggaattaattctttaactgcttgaaattctttattccaggcctcatcactaggaaaaatatcctctagtctccatgtatgctctgcctttacttcacttctctcaggcagctgtgctgctttattttcctcagtcatggtgatccccctcgttttctttacttcaagccaattgaaaaaacgattgtttctccaaaaacttgtgttgtgattatcttccggcttttcactgccttttgtcaaatcatatgcggcatataagaccgagcataccaataatacagtgaaaaaacgaaaacaaaatgcttgtacgcccctcacattcgccaccaccttgacgttagggtgaacgaaatgaagcattctcattccccaaaaaagagcaggtcccgccggcgcagctcttctgccgtttgagggcgcttctgttgagatgagggcatatatacttcattctcaatttcccttaaaaaatcctgcaagcataagaaatcagcatattgttttaccgccattccgataaggctgtcttgtgaaccataccgcatccggatctccttatgcctgattttttgccgtaaatcatgaaccatgccggataatcggatcggcgcgccttttttagaaagttccgcaagccgcaagtataaatggccctgccacacaaaaacgggacttgcaaacacaaagcctgctgaaacgggaataaacacttcagaggggagaaatggaaatgcaacctgatgtctttcgtaaaaaagacgccggataagaccggcatcttcagataaaaaccgcccgcctttgttgcggaagccggtaacggcacgcccccacgaggaaagtctgacgctgcgccgcccttccggatgacaaatgtctttcagatttgctttgtgaagagggattgcggttaagccggcataagaatagccggtgtaaaacggagtgatggaatgcagcctgtaaaaggagcgggcgtcggggcagtaaaacattaaggaggaaaatgaattgacttcaaagaactgccagtgaaaagcagaaagccggaaaaattgcgcggtcatccgttttaaccgttttgccccaatgatccagaccggccggtacccggcgtttttcaggcctgccgtccggctctttaaagagtccgccgaaaggttcgcacattgaaattcaaaagccagcctttcttctccgctttctgccgtcaagtcaggccgctgtccagcggaagtcagatacggttccaggctgacactgcacccttgtgtcttcagccagagaaaaagctgtctttttccttccagatggtattcgctttcaggttcggattccccgggacacagcctgctttttttatgagcgaagtgcggcagtttttcgcgtcccagtttgatatcaagctcacttttgcaaacggggcagaaccagcgtttctttctcagctccgccgctttttcctttgaatagcttccggccagctgaatgagccgtccgccggcagtcactgcactgaacatgttgcatcttctcctttcctgaatcttgttgtattcagcaggaagaaggcataatcctgtttgcggatgagagccgttatacggttttcagccgttcatcctgtcattcagaacaaaaaaaaccgatttctgctgagagaaatcggttttttatgatgcaaagtgtttttttattgtatataacgcatgatcagcgatcactaatttgccgtattcttcaagacggtgaatgctgactgatgattcgtgcgcgtactccaacaggatgcttagctgattttcaacctcttcatcagtttgctcataaaaatctgcatataaataatatcggtcttcaaacgaatacagggtcgttttgattccgttaagattcaattttgatagcgagatgagatcctcaaaatcatcgaaccgcaaagtgaactgaagcttttgctccttatcttcccggctctcggcctgctcttctttctggaaatcatcaagtaaagcatcgagattttcatctgccggctcttgttttttatcttccgggatcggcagttcgagtttttgtccgtccttggaaagctgggcttttgttacgattatttccagtcctttgtccaatgcctgaacctgaatccaaagaggaccctcgacagcgaattcctcttcatcatgcacttcatccatgacttcccagaacagttcttcactgcgctcgcgattgtaccagatttcttctctgtcaaaaccgcgatcttcaatatcaccataagacatataaaattttacagtatgctcattaattctttctatttccattttgccaaccttcccttctttataagatgttgaagggacatctaagctcccgatgaatagtactttactacactttacccattccgtccacatcttaaccttatagaagacagcgcaaattctttatatttctattttatgataaaacagttataaaagaaataaaaaagcattttcacaccgaaaaacaggctttctcccggttcccatcataaatagcgcactgcttcatatattagctgtacaagcaatcgatctataagcgaggtgttaccatgccgcacgattacctgctgtcccttctgcttattatcgggattgaccttattctcggcggtgacaatgccgtcgtcatcgcgatggccagccggaatctggcccataaacaaagacagcaagcgatcatcttcggaacatttatcgcagtcgtcttgagaatcgttctgacgagcgctgcggtctatttattgaatgttccttttttacaatgcgcaggcggggtatttttattgtatctcggctatcagcttctgattgagaagaaagatgcgcagcatgtgaaaagcagttcttctctttggaaagccatccgcacaatcgttctggctgatatctttatgtcgcttgacaatgtcatcgcagtagccggcgcttctcacggtgagctgacactagtagtgatcggtctcttcatctcggtgccgattattatttggggcagcaagctcgttcatgccgccatggaaaaaatgcctttattgatgtatgccgggagcggtcttctcgcatttaccggcggtgaaatgattgccggagacagcaagctgtcatttttcatggcagaacacggcatgatacagatgatgctgccgattttgaccgttgtttttgttatcctcgccagtatgatttaccagcagactgaaaaataacaaaaagcccaaaccgcgatggttttgggctttttccatgcttatcgtaagcttatatcagttggcaagacgctgtgcttctcttaattggaaagaacgcacttttcttggcaggaatcgtctgatttcatcttcgttatagccgacttgcagacgtttttcatcaatgatgatcggacggcggagcagtcccggatgctcattgatcaaagtatataagtcttgaagcggcatagattcaacatttacgttcagtttctggaatactttagaacgggtagagataatttcatccgtaccgtcttcagtcatacgcagaatctgcttgatctcatcaattgataacggctcggagaaaatgtttctttctacaaacggaatctcgtgctcttcaagccaagctcttgcttttctgcatgacgtacagctaggtgatgtgtataatgtaaccattaatcttcactcctctaattagtaggatgaacatgtttgtattctcaaattgaaatgactttaaaaaaggaatctttataggtattatactataaaaaagtaagtgtgaacagtctcctgagaaaaaaatgtgtcaatccggcaaatttacggctggaggatttttccccattctcaattagctcagctgatcgaaaatgtttttttgttttttctcatcaatgactttgagaacttcatccgttttctcgtatgattctccgtaccatttttcatctttataagtgtgaatgttttcatatgtctgtttcatcgcttcaaatatttcttcttctgattccgtcttaggtgaccagtacagaatctccattttgttcacttcattcgtagccaatgaccggcgccgatacccgattgactgcgcgtgcttgaaatgctctctttgataaaaacgcaagcgtttctgtgtatccgtgtcatcctcgtcaacaggctccacctcaagcagaatcggcttgttcttctttttcagtctgccgatcagcttgcttccgaggccttgtcctctggatttctttgacacaaacaggtaatcaataaagatgaaagagtcaaattccgcatacatcagcacgtggtactgcccctcttctttatgataaacatcgctttgctcctttaacagagcttccatatgcgcttttgatttcatttcttcaatcggaaaatattcactcagcttttcgtaccagttcattcatttgctccttatgggttcgttgtcttcacacttttagatataccccatttccgattgtttaaacaatcttacatctattaagacgtgtgatcctttaacatggtttcaatttttttaaaatggtgtgtaatcgacgtttttggtataacggtttgccgcgtcccacaataaaaattcgtcaattccttcatcatgcagcgctttaacctggtcctccacctggcgtttcccgtacttttgataatttccgctgccgagatatgatgccgtgaagtcctgaagccacggacgcgatacaggcgggtgtttcagcttggacagctttttattttccaccttcgcgtattctttgacgacattgtagggctcaagatccggtttatcaatgccgaaatagcttgtccaatggctcggataaatcatggatgaaatgacatcgacctggtctgaaattttgctgaaattctggccgataccaggcgcttccggcagcgtggctgaatagccgaaaatatcaaccgacacatccgcgccgtacggcttgagttttttcttcgcataaccgacaaaatcggtgacggcgtgaacgcgtttttgcacattgctgtctgctgtttttccgtaatcgccgtgtccgtatgtcagttcgtcatcacgtttttcaaacccttcaggaaaacggacataatcaaactgaatttcttgaaaacccatctttacggcttgttttgcaatctttacattgtaatcccatacttctttcataaacggattgacgaacgattcgccgcggccgtttttccagacacttccgtttttttctttaaaggaccactcgggctttttattcgcgagttcgctgtctttaaatacgacaatacgcgcgatcggatagatctttttttcctccagctttttcatcatcttttttgggtctttgatgtacggcttggcgattttggcatactcagaatggccgtccggcttaaaggtgaggttcccgttgtcgtccttgacatcaatcaccattgtattgagctccgttttgtccacaaagtctgtcagctccccgaatttgcttcctcccgctgaatgtcctgtgacgtaaatgccccgcaccttatcaggatgtgaaaaatgcagccctgacggataagcgaaccgtgcatttgatttcggcaattctttttcagccagtgctacttttacaagcggctgctcctctttcacagcggcatgggccggataagcggctgcactgataaacagtcccgcacaaatggcgcacaaaatggttttcatactgatctccccctttttttccattatagaaaaacgggagcaggcttaataaacttgaatgtgcgcaaaaaaatcctccaagactcagtcttggaggatgatacgtttatagataggttttaaattcagcttctgtgcacatgacaaaatgtcccggtttcacttctctgaattccattttttctccttcttggagctgatgaactgccggatcgtatttctttcgcgtgcgatttctttcatagtccggatcaggaagcgggatagcggacagcaatgatttcgtatatgggtgaagcgggttttcgtaaagctcatccgccggcgcaagctccaccaattttccgaaatacatgacgccgatgcggtcgctgatgtatttgaccattgataaatcatgggcgataaacaggtaagtaagccctttttctttctgcaattctttcattaaattgacgacttgcgcctgaatggagacatcaagcgccgaaatcggttcgtccgcgatgataaactccggatcaaccgccagcgctctggcgattccgatacgctggcgctgtccgcctgaaaattcatgcgggtagcggttggcgtgctctttatttaaaccgaccgtttccagcagttcgtgaacccgctgcatccgctcttttttcgtttttgccaggcggtgaatatctattccctcggcaataatgtcggcgactgtcattctcggatttaaagatgcgtacggatcctggaaaatcatctgcattttccggttaaactccagcagcttcttgcgggattttttcccgtggacattttccccgttaaagagaacttccccgccggttgcctcatacagccggataatactgcggcccgtcgttgatttaccgcagcccgattctccgacaaggccgagcgtttcgcctttataaatatcaaatgacaaatcatctacggcttttaccgttcctttctgcgtgaaaaaatgctgttttaagtgtttgatttcgagaagtttctcagtcatttttttcaccttccttcattaaaacaggatgctgatacgtattcggaagctgacggattttagccttcaccgcttcaggcggctcgaccttaggcgcatcaggatgcagaagccacgatttcacaaaatgcgtatcagacactttatacatcggcggttcctgttcaaagtcaattttcatcgcatatgagctgcggagcgcaaatgcatcccctttcggaggattcgtcagatcaggcggcgtacccgggatggccgtcagtttttcctgatcggtgctgtccagactcggcattgaggcaagcagcccccacgtatacggatggcgcggatcataaaagatttcatccaccgtgcccgattcgacgacctgacccgcgtacatgacggcgacccggtcggcgacattggcgacaacgccgagatcatgcgtgataaaaatgatagacgtatcaattttcttttgcagatctttcatcagctcaaggatctgtgcctgaatcgtcacatcaagcgctgttgtcggttcatcggcaattaacagtttcggatttgccgcaagcgccatcgcgatgacgacacgctgtctcataccgcctgaaaattcatgggggaattggccgatccgtttttcgggcatcggaattccgacgagatcaagcagctctatggcgcgctttttcgccgcttcacttgagattttttcatgtttgaaaagcacttccgtaatttgcttgccgactctcatcgtcgggttcagagaggtcatcggatcttggaaaatcattccgatgtcctttcctctgatggcctgcatttctttttcggacatcggcacgatatcgcgtccgtcaaaaagaatctgtcctcttttaaagtagcccggcggcatcggaatcagcttcataatcgcttgggaggtcacactttttccggaacccgactcccccacgatcgccagcgtctctcctttattcaaatggaaattgacgccgcggattgcctgtacctctccgccgtatgttttaaatgaaatggctaagtcttttacttctagcaaacgtgtcactcatatcactccttatttgcgtaacttaggatccagcgcgtctcttaacccgtcgccgacaacgttaaagccgaacatcgccaggcagataaagccggcagggaagaacagacgccaagggtaataggttaatgcaggcaatccgtctgaggccatcgttccccagctcgcaagcggcgcaggtacgccgaggcccaaataacttaaaaacgcttctgtaaaaatcgccgtcggaaccgtcagtgtcatcgttacgagtatagagcccatcgcgttcgggacgatatgcttaaacaaaagccggccggttttggcaccgagtgtctgtgaagcaagcacatactcctgattctttaattgcagcacctgtccgcggacgatcctcgccatattgatccagcccgtgatcgtcatggcgacgataatggtgagcaatcctttcggcaggacaaccatcagcaaaataaccattaataatgaaggaacagcccacagaatgtcggcgatgcgcatcatcacttcatctgtgcgtccgccgcggaatccggaaatgctgccccagattacgccgatcaataaatcaagcacggcagctgcgacaccgataaagatggaaatccgcgcgcccacccatgtccggacgaatatatcccttccaaggtcatccgtgccgaaccaatgatctttcgacggcgctttatccgcatttaatagattggtagtggcataatcataccttgaaaagataggcgcaaaaatcgccatcagaataataagaacgatcagtacgaacccgaccatcgcaagcttattgctgcggaagcggagcatggcgtctttccagagggaaaggctttttttatttattttttcggcatcgccggcattagctgaagctggttcaaacatatttttaggaatgttctgcatggtctaggctcctttctttgctttggaaagcttgattctcggatcgattaatccgtacagcacgtctacaattaatacgcatagaagcaggagcacgctgaagaacacggtaactcccataatgaccgtataatcacggtttgtaatgctgtttacaaaatgcgcgcctaaaccgggaattccgaaaatggattcaatgatgaaacttcccgttaaaatggatgccgccatcggccccatatatgtcacgaccggcaaaagcgcgtttcgcagcgcatggcgcacggtgactgacggacgggacagtcctttagcttttgcagtccgtatgtaatcgctgtttaacacttcaatcatgcttgaacgggagagtctggcaatgaacgccatcggcatggaagcgagcgcaatggagggcagaaaggtgtatgcccaggattcccatcctgcgaccgggaacagttctaatttaattgagaaaatatattgcaaaatcgtcgccaatataaagctcggaactgagatcccaaagatcgttaaaatcgcaatggtataatcctgccatttattatggtacagggcagcaagcaccccgaaaagcacaccgaacgctaaagcgaggagaatagcttctgcaccgagagtgaatgagacggggaagcctgaattgattaaatcattaacactttggcctttatatttaaaagaaggcccgaagtcccacatcgccacagattttaagtagctgacatattgaacgaaaagaggcttgtccaaaccatagtgttcgtttaagtttgcctcaatttcaggcggcagctttctttcgccggaaaatggtccgcccggcgctgcctgcattaagaagaacgtggcggtcacaatcacaaacaatgtgatgatcatgtaaatgaatcgtttaccgatatatttcagcaaggtgaacacctccatgttttttacaattttatacgtaatcagtaagaaaggtatatggggacatcctccccatataccttgggtcttttgttttcagaaccggcttttattcaaaagaagcgtttctgaagtaaacttcgcctgttcctgtcaagatcacatttttgaggtttttatcctgcacccaaggatccgtatagaaataaactggcgcgaccggcattgcgtcgataaagatcttttctgcttttttcagctcttcgatacgtttatccggatccgtttcaagctgagattggttcagcagctttttaaactcaggatcttcccacccggtatcattgtttccgccttctttatcacggaacaattcaaggaagttgatcggatcgttgaaatcgccgagccagcccatacgtccgatttggtagttttggctgtgcagcttgtcgatgtaaacattccattcggagttatcaagttcaactttgacgcccaagttctttttccacatttcctgtacggcctgcgcgattttcgcatgcgcgtcatccgtattgtaggacagcttgatcgccggaaggtcagaggcactcttgacgcctaattccttcagtcctttatttaagaattctttagctgatttgacgtcattgtctttgaagtaaccttttgtgttatccttgaatcccttcattgacggcggcaccgcagccatggccgggatttgttcgccctgcgttacatttttcacgatggacgagcggtcgatcgcataagcaagggctttacggatgttaacattgttcagcggtttcgcttctgtgttgaatttgtaccaatacacgcctgcgatcggttcaacgtgaagagatccgtcttttttcaatgtcggcagagattcagtcggaagctggccgagcggcattcctgcccagtcaagctcaccggcctggaattttttcagttcggtgttgttattgttaatcatcaccatgttgattttcttcaatttcacagcgtctttatcccaatattgatcgttcttttcgagcgtgatggaaccgctgtgtttccaggccgtcattttgaacgggccgtttgacacataattttcgcccgcgtttgtgttccagtttttatgtttttcggcgattttcttgttgatcggcatatacgtatagaatgaagttaattgcgtgaaataaggtgtcgggttattcagttcaacctttaatgttttgtcatttacggcttttacgcctacatcatcaatcttgccttttcctgtattggcagcttcagcgcctttgatgtagtagagctgataagcgtattgtgattcgttgttcgggtcaagcacccatttccatgcatattcaaaatcctgcgccgtcacagggtcgccgttagaccatttcgcaccgtcacgaatcgtaaatgtataggtctttccgtctttgcttgtttcaattttagatgccattccttcttcagggtcacctttggagtttacgcgtgtcaatccttcaaaagtctgtcggattacgcctcctgaaacggaatcattcgctaaacccggatgcaatgagaacggctcggttttaatattgatattaagtgaagtctgtcctttggtgtcttttttgccgccgcctgatccgccgctgaatccgccgcacgcacttaatacaagcgagaagataagcatcaaacctacaatagaccaacgctttttcatgcactaaccccctaatcaaatttttcagcctttactactaaatactcagaaatatcagacaaaataacttaatatttttctaaactttaattgtgttccgtcttttctgattattttatgtaaagaagctgtaacaatagagtgaacaagttcattataatgaaatgaataatttattgcaatactattttctcaatttaaaatatttaaatttggtcagtttttctgtcaaaaaggtgatacacttctatagtttaaagcatgacctaactaaatttttttaatgtaatttccagttcatattgctttttacatataatattcgttatacgaaatgttgatatacgttatcatttaagctttttcagttctttttgaggatttccacccctaaagtaaactggaaataagcttgtattcctctgatgacatttggctataattgatttataatagatcaatcaaatacatttgttgtgattgcgatgatgaagagtagtacacattttcatccgtttgaagagagtctgcggtgctgggagcaggtaacgggcgatgtggaatggacttctgagcagctgaccgaacgttagtaggcccagccggagcagcctccgttaccaacgtctcgagcgattccattgtaatggaataatcagggtggcaccacggttcattcgtcccttttttctacgggaagaatgggctttttttattatgttttaagaaatgaggtaagaactatgaagaaaacgattttttcaggcattcagccgagcggttccgttaccctcggcaactacatcggcgcaatgaagcaatttgttgatttgcagcatgactacaacggctacttctgtattgtcgatcagcatgcgattacagttccgcaggatcggcttgagctgcggaagaacatccgcaatctcgcggctctttatctggccgtcggacttgatcccgagaaagcgaccctctttatccagtcggaagttcccgctcatgcccaggcggggtggatgctccaatgcgtcgcatatatcggcgagcttgagcggatgactcaatttaaggataagtcaaagggcaaagaagccgtcgtgtccggactgttaacctatccgccgctgatggccggcgatattttactgtacggaacggatcttgttccggtcggagaagaccaaaaacagcatcttgaactgacccgcaacctggcggaacgctttaataaaaaatacaatgacatcttcacgattcctgaggtgaaaattcctgaatcaggcgcgcgcatcatgtcactggctgatccgctcaaaaaaatgagcaaatcagatccgaaccaaaaggcattcatcacgctgcttgatgagccgaagcagctcgagaagaaaatcaagagtgccgtgactgattctgaaggcattgtaaagtatgataaagaaaacaaaccgggcgtttctaatcttttgacgatttattctattttaggaaacacatcaattgaagaattagaagctaaatatgaaggcaaagggtacggtgaattcaaaagcgatttagccgaagtcgttatcggcgcattgacaccgatccaagagcgctatcgtgaattaattgagagcgacgagcttgaccgcattctcgacgaaggggcggcgcgcgcaaacaaaacggccggcaaaatggtgaagaaaatggaaaacgccatgggtctcggacggaaaagaagataaaaaaaagaggcgggagaatccccgcctctttttttagttcacttttgattcctgttccatttcccaaagcttttcgaaaaacggctgccctttaatcaaattttcacagaacgcaagatgtttatccgaccagccttcaattgtttcattgtaaagcatgtcccagatctcttcaaaactcatccgtttgatctgctcatacatatgcggattccattccgtgtaccaatacacaatttccgcacggtttttcagccctttcagctggtcgagcgccataaacatcagctgcttgatctgccgctcttttctcgtcagacctctgacatgccccggcgccaatgacaaaatgtgatattcctttgaagactccaattgcgacggctcaaattgaaacgattccggttctacatcctttaccatttcataaacaagctgctcctgtctcggaatcaggcggctctttctgaccggaatggtatacccgatcgtatccacggcaatgatgccgatcccgtctgtcacgacaaaacagtactccagctttgtccgctcatgattttttcgcacgtatgacttctggtggacttggtcaagcagctctttcggaagctctgataagtcgttttctatgtaatgaaataatactgacggcactctgagcagcggcgtctgatccaaaagctcaaccgtgtcttccttccgccattcgtgaaaatggcatacattgtagccgttttcttccccttcaaaccaattgacccatacatcatgaagaaataacatattcgacccctcactttataaaaactgttgtccacagtataggcaagggatagataaattattccatttcaatatgagatttccgttttacggagctggatttccgactgcattgcaacaaaaaaatctcccgttcgtccgggagatcatttcacatttttcggatcaagcgcatcacgcagcccgtctccgacaaagttgaagcacaatacggtaagaaggatcaacaaacccgggaataacgggtaccaccaagcctgtatcataagcgtaaagttctgtgcatcctgaagcatattgccccagcttgcgatcggcggctgaatcccgaaaccgagataacttaatgtagattccgccaaaataaccgttcccacctttaatgtggctgagacgataatcggtccgagcgcattcggcagtatatgagaaaagatgatgtgatggttttttgtaccgatcgtctttgcagctaatacaaactctctggaacgaagcgataaaaactctcctcggacaaggcgtgccgttgttgtccagcctgtaagggagaaaattaaaattaatttatccattccgggctgaaaaatcgtaacaagtgtaattaacaaaaatatatcaggtatggataatacgatatcaacggttctcatgagaacggcatcgacaaaccctttaaaatatccggcaacggctccgacaactgtcccgattgtaatcgcgccgatcacagaagcgaatccgacaagcaaggagacgcgcgccccgtacagaaccctcgtaaagatgtctcttccgaatttatcagttcccattagatgttttaagctcggcggcttcaaacgattgatgagagattgactctccggagagtaaggagcgattaccgaagcgaataaagctgacaagataatgatggttaatataacggctccgattacagctagtttattttgaaagaacttttcgaaaaaaatcttcgtcattgtttccggtttggattgaatattttcctttaatttcacttcgctggggggtgtgccggtatttggctgtaacatttgacctctcacctctctttgttaatattcaatgcggggatcaaccagcgcatataagatgtccgcaattaaattccccactacaaccaaaacagctgaaatgaccgtcatggccatgataaccggataatcccgcgaaaaggctgaatcaataaacaatttgccgagacccggccaagtaaaaatctgttctaccactaccgctcccccgataaatgacggtatcatcaaaccaaaaatagtgatgacaggaagaagcccgtttctcaaaccgtgtttaaaaatcactttattatctcggaatcctttcgcacgcgccgttcgtatataatcctgttttaacacatcaagcatactggatcttgtgtatctcgttatccctgccatgtctgccgtggcgagcacaaaagcaggcagaatcaagtgatgcaatcggtcaaatatgttaaagtcagcattcaaagtgcttactccgccagtgggaaaccaccccagatttacagataaaaccatgattaaaatcaaaccgaaccaaaaattcggaatggcaagccctaaaaatgaagtaacagttatcccgtaatccaattttgaataaggacgtttcgctgacagaacaccaaatggaatagaaatcagaagagcgacaagggttgagaaaagcataagcacaatcgtattcggtaagcgggataagataagttcagaaaccggagtgcctttcttgacgatagaagtcccaaaatccccttgcagcatattccccagccatttcacatattgaacaggttccggatcattcaacccgtatttttcaatgaatttcgccctgtccgcttgactgattgtagggtccatcataagtgacatcgggtctcccggcgctgctttcatgatggcaaacgacaaaattgtaatgcctaagagaatcggcaaggacattaatgttcgccgtaaaatatatgtaaccatattcttgtcccctttttaaataggataagagaggaaaggaacctccttccctctccagggcttttgctatttttgatccagccaccatttttcaatattgtacaagtcatttttagggtggaatacatagccttgtaaattattcggcatcgctctgtggtaattgtaatagaataagaagctgtacggctgatcttcagcaattaatttgtatatctcttcatacttcttttggtattcttttctgtctgtaattgacttcgcttcttcaagcagcttatcgactttcgggtttttataccagatattattcagcccgtttttcgattggcttgaatggaagatagagaattgatccgggaacgttgcaagactccatccgagaagaagagcgtcataatcccaattaggggcacttgtctgttcgattaacgcactgaattcaacaattcgcggtttagcctcgattcccacttcttttaattgctgctgaacgacaacagctaaatcttcacgaattttattgccttgattcgttttaatttcaaatgagaatttttttccgtctttatcaaggtagccgtcaccgtcatggtcttcccatccggcttcttttagcagctgctttgcttttttcggattataatcaaatgtcggcactttagacttcggataattccatgacagcggactctcaggaacatccgctaccttaccgtctccgttcagcacttgatccaccattgcctgcctgtcaagagcgtaagtcaatgcctgacgcacttttttgtccttaaaaagctcttttttctcattccagccgatatagctgtagtttaagccgagatcagatttgaccttcacgtttccaaacgttttaaccgtatcaaaatctgtgcccggcacaacgaagaaatcaatatctcccgcttttaactgggccacggccgcgttagaatcaggaattgttttgactgtcactgtatcaaggtaaggtctgccgccaaagtaatcatcatttgcttccagtttgacatactcaccttttttccactcaacaaacttaaacggaccggagccgattggatttttacggttaaattcattctctcccagatctgcaaccggcaccttacccaatatatgttttggcaaaatgccgtaactgtcgagaacgacattatagaaataggcatcttttttcttcattttaaactgaatttcatattttccttttttcgttacggatttaagggactcaaaacccgagccacgctcaccgttgtaatccttgttaagagggatgctgtaggtgaaaacaacatcatcggccgtcagctcttttccatcatggaatttaacgccttttttcagttttacatcatacgttaatcccccgtcagcttctgttactttttcagccagcgacggcttgacgtttaatttctcatccgtttccaataatgtgctgtaaatcatgccttcaatatcagaacttgcaacatcggtagaataaagtggattaaaaagtgtgggttccccggttgacccgacaaccaaatctccgcctttttgcggttttcctgccggtttggattcggtgcttgtggattttgagccggagcaggctgacaggaagatggcgagcgccataaaaacacttagcatcatcagtgcgcttttacgtaatttcatatcaattccccctttgtgatatatatgcagcaaactggttatgtaatccggcataccccctctcgatgcttgtcatttcaggcatataaatggcaggcgacgtaatggccgggagcggcttcttcaaatgccgggatttgttccttgcagatcggtttggccatcgggcaccgcgtgtggaacacgcagcctttcggcgggtttgccgggcttggcagttctcctttcaggatgattcgttcccgcttgacggcgtctttttttctcgtgacgggcactgaagacaaaagcgcttgcgtataagggtgaagcggattgccgtacagctcgtgtttatcggtcagctccatcatttttcccagatacatgacgccgactctgtcgctgatatggcggacaacactcaaatcatgagaaataaacaaataggtcaggttgaattcatcctgcagttcttccatcagattgatgacttgggcctgaatggagacatcgagtgcggaaacgggttcatccgcaataatcagctcgggattcaacgtcagagcccgcgcaatcccgatccgctggcgctgccccccggaaaattcgtgcggatagcggtttgcaaagctcgggtgaaggccgactttcgccagcagctcctccactcgctcgttccgctcgctcatgctgtacatatggtgagtctggaacggctctttaataatggaacgcagcgttttcctcgggttaagggatgcgaagggatcttggaataccatctggatgtttttgcggacgctttttctcagcttttcttcagataagccggagatatcttgccccttaaagagaatccggccgtctgtcggcttgtataaacggatcatcgtccttcccgccgttgatttgccgcatcctgattcaccgacgatgccgagcgtctccccgcgcttcagtgaaaaagaaacgccgtcaacagcctttatatcaccgactttcctttgaaaaaaaccggagcggatcgggaaatatttttttacgtctttcagctctaaaatcgtttcttggcctgcagctgtcattttgattgggcaccctcttcctcatataaaaaacatcttacagaacggccgctttcatgcgttatcagctccggctgccctgttttgcatttgtccatcgcttttgaacacctcggggcgaatcggcagccttccggaagattatccggtgtcgggacactgcctttgatcgcttttaatgtatcaatctctccatctatcaccggtatggagtttaacagcccttcggtatacggatgaagagggtttaaaaataagtcctccacacccgcactctctacgacttgtccgcaatacataacgatcaccctgtcggcggcttcggaaaccacacctaaatcgtgagtgatcagcagaatagaagtatcgaattttttgcagaggtctttcatcagctccaatacttgggcttgtatcgtcacatcaagcgccgtcgtcggctcatcagcgatcagaagcttcggattgcagctgagcgcaatggcgatcatcaccctctgtctcatccctccggaaagacggtgcggatattctttcatcacttgttccgctctggagaatccgacgagttccagaagctcaacggcttttttagccgcttcttttttattcatttttttatggtattcaagcacttcggtaatttgttcgccgatggtcagcaccggattcagggaagtcatgggctcctgaaagatcatagagacgtcatttccgcggattttgcaatattcgttttcggtgaaggaggccaggtccctgccttccagcttaatcgagccgtccataatttttccgcccgagctttggacaagtcccataatagaaagcgaggtgatgcttttgcccgagccggattctcctacaagagcgacggtttcgcctttgttaatgtgaaaatcaaccccgtcgactgcagggatcggctgtttctttctgaaaaaataggtctttaaattattcacttctaatagtgtgctcatgatacgcccctttctcattccgctgaagcagagggaaacatacgtttcgctatcacaaaatatagaatagtcgaaaaattttatagttgtatattattacatcattattacaaaagcaagaattttttaggataaatgtaatatccttaaataatttccattcttttaatctattaaagcgttgcttccagaaaggtttttgaagggatggccaatgcttcttttactgttttttgatggtcggttaaatatttttttactatattgaatccgacggcatagccaagcattgaggggaagtatccttttccgtataacagctgggaaaacattctgctgtctctcgttaagcggaggttcggcttgactcttttttcaaacaaaaaatcaagctgctcaggcgtatagtaggacgtccattccgccgtaagacttgagccgaaccgctcatatacagcatattctgccagcccctccatcatgattgtatcaagaaatgtctcatctttttcgtcctttgtcacatgttctaaccggcagacgtgattatattcatgtgtcataagggcggatacagctgaattggaactatccgacgatagaaagaggaacattttgtcccgaaaggccagaccggattttgatccgaattcctgacggattttccggtttcgttcatcaacgggcaaaactacgatcggcacgtccggcccgttccacttctcctttaaataggcttcctctttttgtatatggctgtagcatcctttttctttcagccgtttactggtcctaacgccgtccttcagatggcggaacatgccgtggttttgcagcatcccgagtatcggcttccactctttcttatcggcccctgaaaaaagcggcaaaagatgcggggccaggtcatttacggatgccgccttttccatccattgatatgtctgcttgacgctcataccggttcgcctcctcttgttgttatcatatgcacgcacaaaaaaaccggccacctttttcaggcagccggtcaaaaactgtattattgatattttttaaagatcaaagtggcattatgtccgccgaagccgagcgagttgctgagaacgatgttgacatcctgctcgcgcgctttatccggtacataatctaaatcacactcttcatcaggtgtttcgatgttaatcgtcggcgggataatgccgtctttaattgccatgacggagaagattgcttcaattcctccggcagcgcctaacaaatgacccgtcattgattttgtcgaactgacggcaagcttgtacgcatgatcaccgaaaacggtcttaatggcttttgtctcgtatttatcattgtagtacgtgcttgtgccgtgagcgttgatgtaatcaatttcttcaggcttgatgcccgcatctttgattgcttcctgcatcgctctcgcaccgccttccccgtcttgggcaggcgcggtaatgtggtaggcgtcacccgttgagccgtagccgacaatttccccgtagattttcgcaccgcgggcaagggcatgctcaagctcttcaagcacgacgatccccgcgccttctcccatgacaaagccgtcacggtttttatcaaacgggcggcttgccgttttcggatcaggatttgtagaaagggctttgtttgcgctgaagcccgcaaatgacattcttgtcagcggcgcttccgttccgcccgtaatcatcgcatcggcatcgccgcgctgaatgactttaaacgcgtcaccgatagagttcgttcccgtcgcacatgccgtcaccgtacaggagttgactccttttgctccgagagcgattgagatttggcctgtcgccatatccggaatcatcatcggaacaaagaacgggctgacccttctcggcccttttgtcaggaagatttcgaattgggattcaagcgtttcaagaccgccgattccggacccgacccaaacgccgactctcggagcgatctcgtctgtgatgttcagaccggcatcttgaacggccattttcgcggctacgacagcgtattgcgtgaagcggtccatttttcgcgcttcttttttatccatgtgattttcaatattgaaatctttcaattcagcagctactttcgccggatactcgtccgattccacacgtgtgatcggtccgattccggatacgccgccgattgcatttttccagcttgtttcggcgtcgttgccaagcggagacaaggctccaagccctgtaacgactactctttttttactcatcttgtgtgcacctcacctttttttatcgtccccagcgtaatgctatggcgccccatgtcaatcctccgccgaaaccgaccatgacgatgacgtcgccgtctttaattttgcctgcttccagttcctctactaatgaaatcggaatggatgctgcggatgtgtttccatatttatggactgttttagacatcttttcaaccggaagctccaaacgttcccgtgccgcttccatgatgcggatgtttgcctgatgcggaatcaaaaagtctacgtcctctttggagaggccggctttttcaataacatttacactcgattcacccatttgccggacggcgaatttgaatacttctcttccatgcatgattgtatgccctttttcatctaagtacaagtgctgaccgcctgtaccgtctgctccgagctcaaatgaaagtatgcctctgtcgtcgctgaccggtccgatgaccgccgctccggctccgtctccgaacagcacagccgtattacggtcgtcccagtcggtaatgcttgagagcttttccacgccgaccacgaggacatgtttgtatgtttgcgattcaatgaattgtttggcggttacaataccgtacataaaacccgcacatgcggcgctgatatccatcgcgcacgcttttttggccccgagcttctcttgtatcatacaggaaacggtcgggaaagactggtcaggagtaaccgtcgccacaaggatcatatcaagctcctcagcggaaatgccggcctgatcaagcgctttttgcgcagcctcagcggccatgccggatgaatacatatcttcagcggcgattcttctttcttctatacctgttctcgtacgaatccactcgtccgatgtatctaccatttgttcaagatcatgatttgtcagcactttttccgggatgtaacggccgacgccaagaattccagctttcattggaaaagactccttttttataatgaatttaaaactaattagttatgatcaattattagtatcaggtactaattctaccctattttttttctgttggcaatatattcgtctaaactatcggacgctgctcctcatagaataaaaggaagacgaaaggaggcttcactatggatattttctccaaaatgatgttcggcgattccagagaccgggataaagaaccggaagaaaacccggagcagcctcaggctgaaaacgaagaagagatcgattacaaccacgtgttgaatcagctggggtccatcatgaactccctggatcaattaaagcccgtatttaaagactttgcgccgatggtgtccgccataaagaaaaaaatcatgtgaaaagccacttcatgaaaaagtggctctctttatttattcagctccccggcatcagatctgccaagctcatacgcttccgccatgaccgatgtaaacaggtccataaacggctgaatcatttccatagacagatctatgccggatttctcaagctccgcctttgcttccggcaagtatttcatcgcgatctgcataaattcaagagacttttcatgctgcatgtgtatccacctctattcatttgacggcagttcatttgtttgattatacgttttgacaaggtctgagattttgtcttgaaacgctttgtccaccagcgggctgaacgtccccatttcaacgactccttccctgaaatcaaagtcgtgatctccgctcttgagcgtacctttattatattgctcggcaattaatgtataggctttatctacgttttgcaccgtgcttgtcagcaccgtgtttttgccgagattcgattgctcggcgacatagccgatggcgtaaagcccgtcttttttgatttgctgaatgacaggaacattatacccgtctccggccggatatacaacatccgtgccctccgcttttaacttctcgtaaagatgcagcgcttcattgccgttatcccagtggtccgtaaattcagtattgacggtgatatcaggcttttcatatttcgcccctttgataaagccgtctacttcaggctgccacaaaaaggaggcgatgacaccgacctcattggtttttgacatatgggcggccgtcattcccccgaaaaaacccattgcttctcccataaggtgaacgcttgtgacattatcgcttttcgccgttccgtttgcgacgacgaattccatgtcgggataatccttgctgatcatattgaagatttcctcgtattcatttccgtgcccgtataaaagattgactccttttttatgaaaatcatctatcgcttttaaaatatcttcatcggatctgatattttctttataataaacgtcaacgttaaattcagattgtatcgctaataaacctttgtaaccttttgtgccccataccaagtcactgatggtatcggggaaaagcattccgaccttctcaatttttcctttaaacggagtttgtgtgcatccgctcaataaaaggaggacagaaaagatcatgacaagcctggtgatcaagccatgttcaaccccttttcaaactcataacatgtataattgatatacgtttattgtagcggtaatgcacataacatggaaggtatttcttaaaaaatgtcgaatattgatgaaaattgtcttttccattctttaattttttcttccgcttccgttttttgcgttttttcttttatttccagggtaataatctgattttcgtcttctgtgccgtcagcctcaagcttattcatcagcccccagaccgcgtcttctaaaaagatcctgctttctccatcttcttttgcttccgtccacggaccgtaaaggggaggaaggataatcgcttttgccgtatcccgctgaccgtttttttcccagtctccgtgatcctcactgtaaacaatccaatataaaggctcagcccttttttcaggcagacacccgctcccgtattgaacgcagatacgatcgtattccttttcaccgatttcctctattatttgaaaaagcccgtttctcgcgagccacattaaacgttcttctaaatacagctgcctcgttttgtcctccggttctgccaaaatgacatcaacgtgcacaccttcatccatcaaccgttcgcacaatgaaaggccgagaaattcatctgctccaatgatcagcgctgttttcatcacatctgccgcctttccggtttttcatacacacacaagccaaacagccctctgaaaagagatggctgttgtattctattcattacaggtctttttcatgactgcggaaaaaccggcagatggctctgtacatacgagcagggttctcaagcaggtgatacgtgatatcaatcttgcttccggtcttttcccgggcttctttatacgcgttcgcgtgcagggtgtacgggtacggcgctccggtcgttctttgccatatatgtaccggcacgcgggtgcggcagccggtaatggtctgatagctcagtgagcttgcctctttttcagaaacaccgaagctttgtgccgtttccctcagaaactgcttataaaaaaacttattttctttctctgattcaaaatgggcttgaaggtccagacaaggatctaacattgcggctgaacggatatgctccggtgaagactgcagcaattgatcggcgatgagggcgcccatgccttctgcgagcaagtgtattttcggattgagggtttcttgtttcagcacataatgaatcagctgtctggcgtaaagggcggctttttccgaaccccaatgccgtccgtataaattgctgttgaaaatggtgtaccctctgtcaagcagcgtatttaacagctggtttctcccttcatgttcgagccaaaagcttgagtcccggctgacaaagtgagttctgtcccccagaataaagatacagaagccgttcggccgatacggcagatggatgacgttcagctcagatccgaattggaaaaatctttccgttatccccatgcctgcccgcctccttttactcctaatctctctattggctatcatatgtaagaagaatgaaaacggatcggataaactcctatttgctgctatgttttggctattatcccaagcacaggaaccgaattttccgtcagacggcaagacaggcgggcacatgtcagtttcaggcgcgctttttgatgagaaaatgaccttccgcccgcgctttatgtatggtatgatacaacgtagaataaaatgaaggacgaggtggaaacgtgcggtttattatcggttttatttggacgttccttttaacacatatggcctgttatttggtcgcctccatgaacagcgcggcgtacaatttcaagcaatcatccgttattgccgtggttattgcggtgctagtctttgttcttgcggagatcatgcctgtcaaacaggatgcaaaccagcattaaataaaaaacctgctattcagcaggtttttttgtgttcacggttttcgttggtacgtccacaatctgttgtggtttgaagtttcagggaacatttctcccaccgtaagtttgattttttgcggatttttgaccatgcttcccgtttcgccgatttcaacgtacacaccgttattcggcgctttttgtcccgggcggaattgatgctgctgtcccacgtcatttcctcctttttcttttttatgtagtatgcgcttgtatgcggagaaatatcaaaaaccgctgaatgagattcagcggtttttttgttcatcctgtttgtatagaagagctttcaggagcgctttttgcgcgtgaagccggttttccgcctgctggaataccgcagagttcgtgccgtcgataatctcggacgtgacctcttcttcccgatgcgccggcaggcaatgcaaaaatgtatagtcgggtttggcgagactgacgagtgaggcgttgacttgatacggagcaaacacattcagccgctgctgcgtctcttcctcctgccccatgctcgtgaagacgtcggagtaaatcacgtctgcatcccgcaccgcttcctgcggattttcggtaagggtgattttcgctccggaaacagccgctgcttctttcgcggcattcaccgcctcttcctctgcttcatagcctttcggcgaagcaaccgcaatgtcacagcccatttttgcgcagccgatcataagtgaatgcgcgacattatttccgtcaccgatataggcgacttttactccttttaattttccttttatttcttgtattgttaacagatccgcgagtgcctgacacgggtgataccggtcggtcagcccgtttatgacgggaatatcagcatgctcggcaagctcttcgactttttcatgctcaaaggtgcggatcataatggcatcaacgaagccggacagcaccttggccgtatccgcgaccgtctccccccgcccaagctgcaggtcgctgcttgaaagaaatagtcccgttcccccgagctgggccattcccgcttcaaaagacacacgtgtgcgggttgaagatttttcaaaaatcatcgccaatgttttcccttggaaaatcggctgtatcggatgttgttttaataatgaagcttctgtcagaagcgcattgatgtctgacgggctgacatcttttaatgaaagaaaatctttgccgtacaaatgggttaatgtgtgttccgcttttattgtgtgcatgatgccacttccttttgataaagatctttgagcgatacaggctgaggtttgccggagccgcttgctaaaaatgcctttacggtttccggttcagtaaagaccgtcacaccgtgcgtcatggcttcgatccgttgtttacgcgcttcttcagagtgattgaaattaatatggaccgctttatcctttcgctctgcccatgccgggaacgcatctttgcatacggtaaatcccgcctcttgagcctgacgttccaattccgcatcacagccttccagatagatgctgccttttttctcccagacgtgcgcgtagatttttttcagtgcgctttctgcgtcaaacgcgacacacatgccttctccggtcgacttcatttccggcccgggctttacgtccacatcctgaatggcgtgagaagaaaaaaccgggaatttcactgccgttccgtgctgattttgaacctcgggcttgatgtctttaagggaagcgccggccagcaatctggcggcaagcgggatcatcggcacccccatcaccttagacacgacaggaaccgtgcggcttgcccggggattcacttcaagaacgagaatatcccctttgtcatcaatgacaaactgaatgttcataatgcctttaaaagccagttttaccgcgattttttcggcggcctcttttatattccgctgcatatcaggtgtgacagacggacccggaagaatcgcaaaactgtcgcccgaatggacgccggcccgttcaatgtgctctgtgtaagtcggcacgaatacttcatgtccgtcggaaatcagatcgatctccaattcttttcctgtaatgtactgatcgatcaaaatcgggtacggcatgcccgcttctttttccaggagctctgacatttgcgcttctgaatgaacgatgatcatgcccatccccccgatgacataagacggacggatcagcacggggtagccgattcggcttgctttttcagttgcttcttcttttgaataagccgtttcgcctttggcatgtttgaggtcaagatcatcaagcagctgataaaacagatcccgatcctccagcgcatcaagggtttcaaaggatgttccgagcagcggaatgcccgctttttccagcggttcagcggcattgatcgcggtctgtcccccaaactggacgatggcaaaatcaatgttttcatgttccgccacgtttaaaatatgttctgtcgtcagcggttcaaaataaagccggtcggcgatttcataatccgtgcttactgtttccggattgttattgatcataatcgtttcatatcccagcttttgcagggtcagaacgccgtggacggcgctgtaatcaaattccactccctgaccgatgcggatcgggcctgagccgatgatgagagcgcgttttttctcttttcggctgacatctccgtcgctttccccaaggtaggtggagtagaaataattcgtcttggcatcaaattcagcggcgcatgtatctacgattttaaacgacgggacgatgcctgatttctttctgagagcacggatgtcttcttccgtttttcccgtgagagatgcgatcatgacatccgtgaagccttttaccttcgcctgctttaaaagcgggacagacagatgatccccttcttccatcagcttgttttctaatgtgatgatatttcggaatacatggagaaaaaacgggtcaattttcgttttggcatggatatcttctatcgtttcaccgcggcttaacagttccatgacgacgaaaaatctccggtcatccggcgttaccgctaattcccacagctgattgatcgtacagccgccgagttcaggcaggcgggtgccgatcgttttcagctcaagggaggccgccgctttttgaatggccgcttccatatttctttcgatcgccatgacctctcccgtcgctttcatcttcgttccgagcgtgcggtcggcatgtttaaatttatcaaacggccagcgcgggaatttgacgatgacataatcaagcgccggttcaaagcttgcataagtagagcccgtcagcggatttttcagttcgtcgagcgtatagccgacggcaagtttcgccgccattttggcaatcgggtagccggtcgcttttgacgcgagggccgatgaacggctgacacgcgggttcacttcaatgacatagtactgtttgctgaacggatccagcgcaaattgaatgttgcagccgccgaccacatccagcgccgaaataatcgccaggcttgcggaacgcagcatctgatattcttcatccgttaacgtctgggacggtgcgacgacgatagagtctcctgtatgcacgccgacgggatcgatgttttccatattgcagacggtgatgcatgtatgattgctgtcgcgcatgacctcatattcgatttctttaaatccggcgatgcttttttcgacgaggcattggctgatcgggcttgctaacagcgcctgtttaataagcgtctgaaacgattctttcgttttcgcgattccgcctccctttccgcctaatgtgtacgccggtctcagaataaccggaaatccgatagactcagcgaagcggagggcgtcttcttcgttgtcgacgatttcgctttccggaacgggctggtcgagctctttcatcagggcgcggaactgctcccggtcttcgcctttttgaatggtttccaccgatgttcctaagagcttgacgtgatgcttcttcagcacgcctgcttcttcaagtttaacggctaaattcaatgccgtctggccgcccaaattggcaagcagaccgtcgggcttttctttttcaataatggcctcgatgctgtcggttgtgagcggttcaaaatatatttcatcggcaaacgcctcatccgtcataatcgttgccgggttgttattgactagaataacgcggtatccttcttctttcagagccatgcagccctgcgttcctgaataatcaaattcagccgcctggccgatgatgatggggccggagccgatgactaatatgctggaaatggttgtatctttaggcatgagcgatttctctccttgctggtatcactttctctagaaattcatcaaatatccactcgctctcagccggaccgggatgagcttcagggtggaactggacgcttaatacgggaaggcgcttatgaatgagcccttccactgatgtatcattgacatggtgaaatctgatggacagctcgttttcgtcaattgacgcttcatcgacgacatagctgtggttctggcttgtcataaacacccttttcgttttccggtcaatgacgggatggttggcacccctgtggccgaacggcagcttatacgtatttcctccgaaagccagggcaatcagctgatgcccgaggcaaatgccgagtgcagggaaatcactgagtaaagatgtaatccggttcatgtacggcgcaatcgctttcgggtcgcccgggccgtttgagagcacgattccgtcaggctgaatgtcataaacggcatccatctgctgatacggaatgaccgttactttacagccgcgctttacaagtgacgaggcgattgattttttataaccgaaatcaatcagcgcaatatgccggtctccgttccccattgaagtgatgtcttcagactgcgccagctccgccggattttgtgttccggatgctgcgggaatttctcctgctgttgacacagcagcgttcatcgtgccgccggagcggatggctttgacgacggcccgtgtgtccacttcggttaagagcgggatgttccatttatttaaatactctctcaagcttgagactgcttcatggtgagaaaaatgttcacacgcttcatagacggcaacagccttgacttgtggaattttactttcaaggtctttttcattaattccgtagtttccgatcagcggatacgtaaagacgatgatctgccccttatatgacgggtctgtaagcacttcctgatagcccgtcattccggtgaaaaaaacagcttcgccaacacagcaagcctctttttcaagttcaccgccgaatgatgttccgtcttccaatactaaatagcctttcatctaaagcccacctcttgatgaataattaattaaaaatatgaatttttatacctttatatcgaaaaaaattaccgtttcactgccgaatgcgcttcgatcgctgctttcagcatactgacggccgacagcatttcttcttcagaaaccgtaagcggcggaagcagcctgatgacattcggtccggccggaagcacgagaagcccgcgttcctgcagatctccgatgatgccggacacgggacctgcgcattcaatgccgattaataacccttttccgcggatttcttttacaaaaggccctgtcagttcacggttcagctgcgcttttaaaaaagagcctttgtctgccgccgcctggagaaagtccggctgaaacacaatgtccaaagttgctttcacagctgccatggcgagcttattaccgccgaaagtcgtaccatgcgtacccggcgtaaaggcgtcggcaagcttctttttgccgatcacggctccgacgggaaaaccgtttccaagccctttcgcagcagtgatgatgtccggagagatgccgaagtgctcatagccgaatgccttgcccgtccggccgattccggtttgaatctcgtctgcgataagcagcgcctgtttgtctttgcaaaatgtctgtaaggcttcgatgaattccggatcggcgggattgactcccccttctccctgcaccgtctcaagcatgacggcggcgatatcatcctcttttgaaagtgtgctgaatgccgacgggtcattaaacggaagatagtgaaagccttggagcatcggtccgaaaccggtcttgattttgtcttgtccggtggcggccatccccgcataggtccgtccgtgaaaggattgatgaaatgttacgatttttgtctttcccgttgctttacgggcaagcttaatggcgccttcattcgcttcggctccgctgttgcagaagaaaacgagatccccgcgctatgtccggcaagctttgccgcggctttttcctgaagatcattttcaaacagattggaaacgtgccatacgctgccaagctgttctttcaccgcttccgtcaccgcatcatgacaatggccgagattggaaacggcgatgccctgaataaaatcgagatacgtttttccgttttcatcctctgcgattgtccctttcgcttttttaatatcgataggccagcggctgtaggtttgaaataggctgctcatgacacgctctccttttctttaacgatttttgttccttggaagacttgattggtgaaaaacgctccttttccgtttacgatcatcacttcctcgacatcttcactcagtgccgataatgccgagtttaccttcggaatcatcccccctgaaattacgccgtcatcgatgagggcctgaatttcttgcggcgtcaaagtatccagcctgttctctccgtccataattccttcgacatccgtgacaaataaaagtttatcggcgtgtaaggctgaagcgacggccgatgccgcggcgtctgcgttgacgttcagcgtttcgaaatcacttgtcatggaaagcggagcgataacgggaatgatgccttctttcattaatgcgtggatgattgacggatcggttttttgtatttcgccgacttctccgtatttgtcttgattaaggtaagacgcttgaaggagaccgccgtcctttcctgatattcccgcggctttcagcccgtttttcgcgagttcggttacgaaaaatttattgatcgtccctgacaagaccatttccgctgtttccagcaccggtttggtcgttttccgctgtccatcgacaaattccgtttcaatctgcaatgttttcagcattcttgaaatgtccgggcctcctccatgcacgacggcaaggttccagcccgattgcataagctcttttacattttgaaaaaaatcggcggataactcgcggattacactgccgccgcacttaaaaacgatggttttcttcatgccgctcccctttgctatgtgcgatagctcgcattgattttgatataatcataggttaagtcacagccccatgcccggccgctgccggagccttcctgcaggcggactgcaatcgtaatttcatcacctgataagtactccttggcatcagtttccgaaaacggctgaggttcgttgtgtttaaacagacactgaccgccgaggaaaacttccacttgttcggccgttacgcttgccgcactgtgcccgatggcgccgatgatgcgcccccagttggcgtctgtgccgtaaacggcggtcttcacaaggcttgagccgacgatttttttggcgataatattcgcctcaaggttatttttcgcgccttcgactctggcttcaattaatttcgtcgctccttcaccgtctctggcaatatctttggcaaggtcttcgcatacaagctttaacccctttttaaatgccggccagtcagggtgctgctccgtcaggcaatcattccccgcgcagccgttcgccatcacaagcaccatgtcattcgtcgatgtttctccgtcaacggtgatttggttaaatgaaacatccgtaatctctctgagcgcatttttgagcgactgttcttccacggccgcgtccgttgtgacaaagccgagcattgtcgccatgttggggtggatcatgccggagcctttcgccgctccgccgatcgtgatgatgtttccgccgatcaccagttcataacacgtctgtttcgtcactgtatccgtcgtcaaaatggcttcttcaaatgctccggacactgacggcgcttgaccgagctgttcaatgcccgcctgaatttttttcatgtctaaaagctcgccgatcaccccggttgacgaaaccgcaacaagctccggctcaatgccgagctggctcgcgaagccgtcccgcatttcataggcgtcctttaatccttggtctcccgtacaggcgttggcaatcgcgctgttgacgataaccgcctgaagcacggcctctttttttaagctctcttgcgtcactttcaagggcgctgcctgaaaatggctttgcgtatataccgccgcactgactgcaggcgcttcgctgataatcgctccgagatctttttttgaatagcgcagaccgcagtgcacgccctttgcctcaaaccctttcggcgaagatacgccgccttttactttcgtgatttcctcactcagctgaatcatattttcgaatccctctttcgttctatggatagactggcgtcatcgtaagtcccgtttcttcctgccagccattcatgatatttaaattttgaaccgcctgccctgcggcgcctttcatcagattatctatgacagaaacgatggtggcacggtttgttctttcatccacggtgacactgatatcacaaaaattgctgccgtatacctctttcgtcgccggaaattcaccttccggcctgattctgacaaaatatgaatctttgtagaattcggaatacaattctcttacctgtgcagcagacataccagggggagcctccgtatatatcgtcgccataatgccccttgtcatcggcgccaaatgtgcggaaaacgtgatcggacctgtgccgggctgccaagccgctaattgctgttcaatttccggagtatgctgatgctcattaaccttataaattttaaaattatcattcagctcagaataatgagtgcccatggatgcttttcggccggcaccggatacgcctgttttcgcatcaacaatcagaaaagaatcttgtaaaagcttattcttcgccagcggggcgagcccgagcagcacagccgtcggaaaacatcccggattggcaatcagcttagcagtctgaatctcttctttttgcagttcggctaaaccgtaaaccgcgctttgaatcgttcctttcggcgcggccttccgcttataccacttttcatacacggccgggttttgaatccgcagatcgccggatagatcaatgaccgggatgcccgcctccgccagcttgggcgaccactctccggaaacgccgggcggcgcggctataaacatgacatcaatttcgtttcgaatcgtttctatatgaagcggctgaagtgattgtgacgctatattcctcaaatgcggatatgaagcggcatattcttttccttcgtcgctcgatgaatataatatacaatcttctgcataagggtgatggttaagaatcctgacaagttcggcgcctccataaccagtcgcgcctataatacctattttcaacgggttcaccttcttggtttttgtgaaattatttaacattataacatgaataaaaattaattcaattgtatatttaatattttttcattcattttccatcggttttcgctgacaaaaaccccctctcgatcgagggggtttcataagaaaaacaggctgatcggatcagcctgtttttttcagcatcatcagcccgcttataaaaaacagcacggagctggcgtaaaaaataatataaaccgtgaagaaatcagcgagaaacccgccgagaataatggcggcagctgaaaatacggccgtccagaaatgatagctgccgacttttttcccccgctccccgccgtcagtgtaatcggcgatcatgattttctcgccgtgtttttgcatggcgccgaacaggcccaaaagcacctgcaccacataaacctggtgcacgccggtaatgtgcgggagcgtcagaagaagcaccgccatcccccacgaattcgccatcaggaaccagcggggatccagtcttgccgacagccggccgagcagcggatgaatcaatgcgccgctcaggccgaacaagccgtatgatagaccgaattgagtgtagctggaaccgatgtttttaataaataaaatataaaacggaaagatcaggctgccggcaaaaaagacactgctctgagacaggatcagccattttaaatggttgtgtttcatgatttgtacctctgataaaaataattcataaacaagtcatcgggatcatatttgtgttttttctgaaagaacatatcgcttttcggatatgcctcgcgcatctgctctttcgtttgatacagcatatacggcagataatagctgccgcggtggcgcaacgccgtatccgtcatttttctgacaatccgcgctgcactcgcctggctgtcttttgaaaacccttcattgattaaaagaacgagtgaaaacatgtcttcctttgcgtatgacagatcggctttttcatttttttgcacgtagcggatcgtaatatttacgagattgagatcttcatgtgacagcgtcttgcgtaaatcatgaatgtacggtgcaaattcgccgacgggcacgaagtattcttgaagcacgtcggtgttgtccgtgttttcatattccaaaaatttcgattctgaccgcatgacattgttcctggagactttcacgccgttttgactgagaaaataagactgctgggttgaccagaaccaatttcttccccagtcataccggcgggagaggccgagcgcgaatttcgtcagcgccggatgctcatcttctttcagttcattgtgccgctttaattctttctggttgtctgagagtgtgtaatcagtcacatacatatcgtgcaaaaagcctttatcccctgttgcgatccgcgcgagatgcatgcgcacggcggggttgcgctgaacatgctgcgtaaaatattgactgtatgtatcagcgttcatgcgtttcgttttcatttcataaagctcatcatccgtcagctcaatatccgcgtcaaggatgacgccgaacaggccgtagccgccgatgacggctgaaaacaggtcatctttcggagtaacggtgatgactttgccgtccgcctttaaaagatgaaacgatttgaccgtatcaatcagcgaaccgtaccggatatcccggccgtgggcgttggcgctcagtgagcccccgatcgtaaaaatgttttgcgattgcatgacttttaccgcgagcccgtacggattgacatagcgctgaatatcattccacgtcgctcccgcctgcactctgatgatttttttctttcggtcgagaccgagtattttgttgtagcccgtcatgtcgagaacgatgccgtcttcataatacgtctggccgcccattgagtgctgggcgcctgcgattgagatcttcaaatgctttctctttgcttccttaatcgtttcgaccaatgtttctttctcttttcctttgaccgtctgcttaattttcacgggcatgagacggcttacatccgtcattgtccctgcctgccgctccggctctttgtgaaaggcggaaacagcgaacagcgccgtataaacaagaatgctaaggataatgagaagtaattttttcttcatgggttcctccctcgcatgcagccggtctattatatcatgcctccgtccgtttttttcctttttaacccgataccgcaaaaaaccccgaatggcgggaaacttgttttttttagtgacttgcccttctttccgcacgccggtctgcagcgacaaagcagacgcgtccggcagaatcatgtttagtacagttcaaaacggtcatccggaaaacaccaggcataaaaaatacacagaaatccctaaaaatgattttttagtcagtatataatcgatatatatgcagatgtattaccaaagggattgtttaaaacaaagatgttaaatgaggtggggaaaatgaacataaaagggatcaatcatcttcttttttctgtttcagatttggaaaaatctatagaattttatgagaaagtatttcatgcacaacttctggttaaagggcaaaaaacagcatattttgatctgaacgggctttggcttgcacttaacttagaggcggatataccaagaaatgaaatacataaatcctatacgcatacggcctttacaattgacccaaaagattttgatgcaatacttcaaaggttaaaaaatctaaatgtaaatatattaaatgggcgtcctagggataagcaagatcaaaagtcaatttattttactgatcccgatggacataaatttgaattccgcacaggtacactccaagacagactgtcctattacaaaaaagataaacctcatatgaaattttatatataaaggtttgtttgcaatccaaaacaagccctcactgtcgcttatatgcagacaaaagaaaagcacctccaaactttaggatgtacctaaaatccggggtgcattttcttattactgaatccctaatgcgatttttgcgtagcgtgacattttgtctcttgtccacggcggattccagacgatgtggacctccgtctcttttacatccggaatgtcggcgagcgcttttttcacctcgtcgacgatgatcggagcgagcgggcaccccattgatgtcagtgtcatcgtaacgtgcgtcaggccgtcgtcatccatatcaacgtcgtatacaaggccgagattgacgatatcgacgccgagctcagggtcaacaacctgctccaaggcgcccatgatgttttcttttaatgcttcttccacgttccatcactcctttttcctcagtataacgcaaaagcggcttttgttaacacctttgtgctttataaatgcttatcgaaccaggcgacggtttctaaaacggcgtatctcgggactttatgatcagcccgttcgtctttcagaaactgaagatggtcgggccggctgctgtaatgaggtttaatcgtttcataaaagccgcgggtcggtgcatacggaacgactttgtcttgaacgccgtgccagaacagcagcgggcggctgcggagtttttccggttccagactgagatcgaacggtttgagccgcgcaaacagttcatcgacctgttcttttgtgacgtcaatgtcgatgtccttcttttgaatgtggtcaatctgctgctgaaaaaatgccgtatagttcggacttcccatcagactgacgccggctttgacccaatcatacgcagccatcgcgccgaatgtcgtaattccgcccattgacgtccccgcaagaccgatccgcccgtcttcaatcagaccgcgcccttcaaaatcctttttcagcacgtcaagctcctcgatttcatttaagacaatgtcccaaaaatggacggcgagctcttctgctgacagctgttcagcgcgttcaccgtggtaaagagcttccggcagcacggctctgaaacccttttcagcaagcaggtaagcgaaatgaagattatgctccttcgcgcttgtaaaaccgtgaataaagaaaacaaggggagcgggacggtcccgattttcttcttttacaatatgtaaaaacggaatgcctgatacggtttgatgatcaataagaatcacgttgactccctccttaggataaccataatcataagtgtaacatgtagacaataaagatggtaaaaagctacactgtacataagagaaaaacagcaaattatatgacaaaaggagttatttatggagacaaaaccttacctcatcgccttagatctggatggaaccttattaaaagatgataaaaccatttcccctgaaacggcacggacgattcagacgctgaaagaagcgggccatcatgtctgcatctcaaccggccgccctttccgttccagttcgatgtattatgacgagcttgggctgacaacgccgattgtcaattttaacggagcgtttgtccaccacccgaaagacgagtcatggggacgataccacacgtctttatctgtcgatgtggtcagacagcttgccgaacttacagagacctaccaaatacataatgtgctcgctgagatcattgatgatgtgtacttccattatcatgatgagcatttaattgaggcgtttcatatgaatacggcgaatgtcacattcggcgatctgcgcgaaacggtccaagaggatgtgacgtccgtattgattcacgcgaaggaagaggacgtcgcggacatacgcgcgcatttatccgatgtgcacgccgaggtcattgaccacagaagatgggcggctccttggcatgtgattgaaattattaaacacgggatgaataaagcggtcggcctgaagaaaatcagcgactattaccaagtgccgagagaacggatcatcgcgttcggcgacgaagacaacgatcttgaaatgctccgatttgccgggtgcggcgtagcgatgggaaacggcacggatgaagtcaaacaggccgccgatcgcgtcacgggttcaaatgaagcggacggaatcgccgaatttttaaaatcctatttctccctgtgaggttttcccgctcataacacaaagccttccgcccatactaaaacagacgactcatctcgtctaaatatggaagggggacattgcaatgggtaaacgaaacaaatcaaaacggtttattcagcaaggcaaggactctgtcagtcttcatgacgcaagatttccatatcggtctacattagaggaagcacagcatgatgcagcaaaagattcggctgaaaggcaggttgacttttaatgagaaacgaactgttttctcaagccaagtcatttgtccagcaggccgtcatgattgctaacggtttcgaggacggcgaccaggaaaaagctgtctcacgcgccaaaaatgccgtgtcttccgcgtacgccaattcgacggatgcagaacgtcagcagctgcaccaatttcaggatcagctggagaaattgcaataaaaaaaggcgccccgtttagatgagggcgccgcttttttatattacttcaaatgtttttaccgttttcagtctttttccgatctgatcggacttccctaaaaacgtcaccgtcaccgtgtatgttcccggaccgggcacgttcttccacacatctgaaaagtcatacgtttcattcggcattaaggtcacggtctgaaacgcctgggtaaacattttgtcttttgaatagcggtacagttctttgtgatgttggtcatgtacggtcagttcgaatttctgccctgagctgaatgtgaaatcgatcgggctttcgcttttgttttttaaagacatttgaaattcgatctgctgatctgtctgcacaggatttacggctaattccgcttgctgttcattcatctctccggatacctcctcagcgggctccttctgcccggattgactgctgcatccgatcaataaaatgaccggtaataacaggccaaacagccacttcattctatccgctcctatcagtcttttctgaagaaaccaaagatccccgtcgtttgcacgatgtttgtgaaggctttcgggtcgacttctttcacgattttctcaaggtcatacaattcgtaccgcgtgatgacgatgatcatcatttctttctgttcgtttgtgtaagcgccttttgccggcaccgtcgtaatgcctcggaccattttcccgtaaatcgcttctttgatttcatcagctttttttgtaacgatcatggcggtcagtttcatgtggcgcgtgtgaatggcgtcaatcacccttgttgtgacatacagagcgacaagggtatataatgctttctcccatccttgcaataatcctgccgtcaaaatgataatcccgttcaaaatgaagaaatatgtgccgaccggtttatccttccatttggccagcaccatcgacacgatatcaagaccgcctgtcgaagcgccgaatttcagcgttaaaccgatgccgatagctgagatgactcctccgaatacggtattcagaagaatatcgtgtgacagtctcatttccgggagaatccccataaagacggacgtcagcgctacgcttaatatgctgtatacggtgaatgatctgccgactttcagccaccctaacacaccgatgggaatgtttaagaggaacatgagaactcctgtcgaaatataaaagggggcgtattgatcaacgacgcttgacagcagctgggcgacaccggtaaaaccgctggaatatacatttgccggtatcaggaataaattcagtcccgccgcatacagaaacgcgccgatgacgacgattgctaatttttttacttgttctagtaccatggcttgctcctccgctcattttcattattagcttttcccttaaaataaagttttgaacactattttgccaaatttatatgatatagttggcatcactctcaccaaccggaaagaagggaattatgatgacagttcaccttattgctgacagcgcctctgacctgccgaaatcttatattgaagaaaaccggatcgggttcattccgctgcacgtaacacttgacggaaacgaatatgaggacgcggtcaccattcaggcggatcatatctttcaagcgatgcgggaagggaaagttccgaaaacatcccaggcatcaccggatacgataaaaaaagtatttttacaatacgcggaactgggagaaccggcgatatacatcgccttttcctcaggtctttccggcacctatcagacggccgtaatgatcgccaatgaagtaaaagaggaatttcccgattttgatttacggattgtagattccaaatgcgcttcattgggctgcggcctcgcggtgatgcacgcgcaaacactctgtgttaacgggaatacaatacaagaaatcgaaacgtctgtaaagaacttttgcgcacggatgaaacatatatttacggtcgatgacgtcgcctatctcgcacggggcggcagaatttcaaaaacgtccgcttttgtcgggggcttttgaacatcaaaccgattctgcatgtggatgacggcaggctcgtgccgctcgaaaaattgcgcggacagaagaaactgtttaaacggattatagaaatgatgaaggaagaaggcggcgattgggcggatcaaaccgtgggaatcagctatgcagataatgaagagacggcgattgggatgaaggaaatgattgaagaagcgttccatccgaaagaaatcattcttcattcaatcggctctgcgatcggcgcccactccgggccgggcacgctcgcgatttttttcctgaagccataatttcaatgcgggcgggcatcctaacggacagaagggaggctttgccgcatgaaagatgatgacaaaaaaccgttggacaataacgccgtaaaccagaaaaagaaccggcttgccgaaaaaaaccggcaggcgggaaaaaaccagaattccaaaaaaccggaccatctgtaaaagcaaaacagccctcttgtcttaggagaaagagggctgttttttgcgcacggatgtctgttacaaagtaaaccggcggacctgatcgtttaaccgctctgtcaggctcaccagattattgacgctttccgccattttatgaaaagaagacagctgctcaagcgcggaggcagaaatctcttcgcttcctgcagccgtttcctgaacgacggcgctgatgctttcggcatgatgcagcacttgctcaccaagctgtttcgattcgatgatccgtccgtccaattgagtaagctccgccttaatatgggcggctttttgttcaatatgggcgaatgattctgacgttttctccatcagctcctgctgtctgtccgctaaagcgacgccggtcgtgacagctccggtaatagatgtgatgccgtcttcaatttgctttaccatatcgaaaatctgcgcggtcgctttggctgatccgtctgcgagcttccgtatctcctcggcaacgacggcaaatccttttccggcctcgcctgctctggccgcctcgattgcggcgtttaaggacagcagattggtctggcccgcaatgtcggaaacggtctgcgccatcatactgatgcctgccgcatgcttagcggctttgtccgcatcgtccgtcatcgtttttttgagcgccgccagtttatccgagctgcttttcatatagctttgtacatcttctttctgggcgtctgcgagcgtataggaatagccggtgatgctttcttttaacgtattaaggtcggcttttgcttcctggacgtttaacagcgcgtccacttcatcttcatttgaagcctgaatcttcatcatgtttacgatggtaaagccgatgacggcggcgaagcaaatcatcgtaacggctgcgttaacgagcagccttgtccgtaatgtcacttcagatcgcctcctttttcaatcagactgtttttcatatccgtgatctttttcgtcagcccgcctgcgtttttgacaactctgatcttggctaagtccatgccgttttccttcagtccgtaaacgatctcaccgcttttgatctccttgttgtcttttaaatctttcgccaattcatagatgacatggtcgacgtttttcactaaagaagagataacggcgtgctcggcggtgtaatattgatcgctgtcaacaccgatggcgtatacttttcgcgcctccgcttctttcagtgcgccgacacccgtgaagccggccgccgtaaacaggacatcggcttttcttcggatcatgttttgggcgatgcgcttcccgagcttatcatcatcaaacgtaccgctgatttccgacagcacgcggatgttcggtttgactgattccgcgcctttcaggtagcctttcttaaaccgtttaatgacgtcggcatctgaaccgccgataaatccgatcgtgccggttttgctcgtcatagccgcgagcgctccggctaagaagcctccttcatcctctttaaacgtgacggaggtgacattatccaggtctgatacagaatcaatcagcacaaaccgctgcttcggatattttttggcgaccttttctaaatccgcctgcatgctgtaaccgagccccacaacaagatcattgccttcccggacaagctgggtcagtcctttttcgtacgtaccggtgtcttttatttctctgtaatcaaatgtgatgccgagctcgtctcttgctttcatcaaaccttgaaagcctgaatcattaaatgattggtcgccgaggccgttgtctgtcagcatgatgccgattgttttcgttttttcagccgccgcccctcggatttgccggcacatcccgccgtgctgagcgcaagcagcagtacagccgcaaatatcgccatttttctcattgaaactctccttttgtttttttctatagttatatatcggttcggatgtcagaatattttatttcaataaaatatgtatgttcggcaggttgataaacaaatgagggcataggagcttttgagaaaataaaaaacaccggttttggttcaccgatgtttttgcagaaaatttattgtttttcgtatgtccagccgtctttctgatacactttgccgtttttcatcaggtgcccgagcgcccgcttaaaggcggctttgcttaaatgaaaccgttcgcggatatcgtcaggatcgcttttgtctccgtaaggcatcgcgccgtttcttgatctcagataggtcagaatctcctccgcgtcaaccgaaagcgcatcctgctttctcggcagcagggacatgttgacggagccgtcttccttcacctcgatgacacgccccgtcacgcggctgccgagtctcggctcttcttttctttctgaagggtgaataaacgcgcggatgccttcatcggtaatcagaaaagagcctgatgcgatcagtctgtacaccgtgcctgtcaggtctttattcatgacgtcttcctctgcatccgtaaataattcactgatgatatcctcaggcgccggcttggcaaacatgcgtccgcggcttgtcaccttcagcatgcaatacagtctgtcgcctttttgcggccagacggatttgtacggaggcaggtgctccgttgcgacgagcgcgtcttttgacagaccgacgtcgacgaatacgcccatatcctccacagcgtccgtcacttccacccatccgtagtcataaaagctgatgagcggctttttcatcgtcgccgcgagtctttcctgatgatcgacgtaaataaatacgtccacttcatctctgtcttcaatatcctctgtaatttcactgttatgtaaaagaaccgtatcctcgccgtcggttaaaaaataaccgaaatcggtttggtgatctatactaagcgtgagctgctgccctggtctcatgttatcgtccttcctgattcgcccgtatggggctgatgtttttctcattttttccaatatgcataaattcatgctttatgcagttggacatttctctttattctactataatcaactcataagtgaaatgttataggaggttttctcatggcaaaagaaagttcttttgatattgtatccaaagttgaatttcccgaagtgcagaatgcgattcagatgacgctgaaagaaatcggcacgcgctatgactttaaaggatctaaaagcgatgtaactttagaaaaggaagaacttgtcctgatttctgatgacgagtttaaactgaatcagctcaaagatgtgctgagcggcaagctgatcaaacgggacgtgccgacaaaaaacattgaatacggcaaaatcgaaaatgcctcagggggcacggtgcgccagcgcgcgaagcttgtacagggcattgataaagacagcgccaaaaaaatcaacgcggtgattaaaaactccggcttgaaggtaaagtcgcagattcaggacgaccaagtgcgcgtcaccggaaaaaataaagatgatctgcagcagattattgcagccgtccgcggggcagacctgccgattgacgttcaatttattaattttagataaattatgtgattcctattgattattgtctctattttcggtaaatttggagaaagggattttcacagttaagttttggaaacccatgacaattacatgaacgttcttatcaagagaagccgagggactggcccgacgacgcttcagcaaccggtgtaatggtttaacccaaaccatgaccaaggtgctaaatccagcaagctaaaaacagcttggaagataagaagagagacaaatgattacagagtcttcttcttaagaagactttttttatttctcttttttccttgctgaatgtgacgaaggaggcaaacaatgggactattacaagacttaaaagaacggattttaatcggagacggcgcgatgggcactctcctctattcctacggcattgacagatgttttgaggaactgaacgtatcaaagcccgaggaaatcaagcggatacataaggcttacgtggaagccggggcagacatcatccagacaaatacgtacggcgcgaattttattaagctctcaagatacggacttgaggatgaaacgaaaaaaatcaatcaggaggcggtcagaatcgcgcgcgcttcctcagacggcgcttatgtattgggaacgatgggcggcatccgcacatttaacaaaaacgcctacagcctggaggagattaaacgcagctttcgggagcagctttatttattgcttcacgaagagccggacggtctgctcctggaaacatactatgatttagaagaggcgcgcgaagtgctgaagatagcgagaaaagaaacggaacttccgattatgctgaatgtatccatgcacgaacagggcgtgctgcaggacggaacgccgcttcgggaagccctcaggtcaattgccgatctcggcgctgacataacgggaatcaattgccggctcggcccgtaccacatgattgaagcgctcaccgaagtgccgatattccgtgacacttatttatcggtctatccgaacagcagcctcccgtctttagaagaaggccggcttgtttatgatacggacgatgcctatttccgggagagcgccgtacagttccgcactcagggcgcgcgcattatcggcggctgctgcggtacgacgccaaaccatatcagagccatggctgaagcggtccgcggactttcccccgtcactgataaagaagtgaaaatcagacgggaagaagaagtcatctccgtccggaatgaacggaccgagccgggtttaaacgaaatcgccgctcaaaaacggtcaattatcgtagagcttgatccgccgaaaaaattgaattttgacaaatttctgcaagcggcggctgaattaaaagaaaccggcatagaagcgctgacgctcgccgacaattcattggcgacaccgcggatcagcaatgccgcctgcggttcattgctgaaagaacgccttgatatccgttctctcgttcacattacatgcagagaccgcaacatcatcggccttcagtcacatttaatggggctggatacgctcgggcttaccgacattttagccatcacgggcgatccttcaaaaatcggcgactttccgggggctacctccgtctatgatttaacgtcctttgacttgatcaggctgattaaacaattcaacgaaggcatttctttatcagggaaaccgctcggcaagaaaacgaacttttccgtagccggagcatttaatccgaatgtccgccatcttgataaagcggtaaaacggctggagaaaaaaatcgagtgcggagctgactacttcgtgtcccagcctgtctactcggagcagcagctcattgacattcatcatgaaacgaaacatctcaaaacaccggtgtatatcggaattatgccgttaacgagcagccgcaacgcagagtttattcatcatgaaatcccgggcattaagctgtcagacagcatccgggaaaaaatggcgctcgccggcgaagacaagcaaaagcagaaagccgaaggcctcgccatcgccaagtcgcttctcgacacggcgtgcgaactgtttaacggaatttatttaatcaccccgtttctccgttctgatttgacatcagaacttgcagcttatattaagcaaaaggatgaaaagcgggctgatgtatatttgcattgacgcggaagatgccgcctgatacgacaggcggctttttcatggtacgatacagaaaaagaatcaagcaaaggaggattttttcatggttgaagtaaaacccatcaccgcagaagacacatacgcgatcagacacagcgtgctgcgcccccatcagacgattgaggattgtaaatatgatcaggacagcgtcaaaggagcatttcatctcggaggtttttacgacgggacattgatcagcatcgcttctttctacccgcagaaccagcaggctttacaggcggcgcccgcctaccagctgcgcggcatggcaacgcttgaagaataccggacgcaaaaagcgggaagcacgttaatcgcctatgcggaacgaaaactggcagatatgggggcggcgcttgtctggtgcaacgccagatgtcacgtgaagggatattacgaaaagctcggctggaaaagcacgggcagcccctttgacatacccggcatcggcccgcatgtgatcatgtataaagaactcgcctgaaacaggcaaaagcccgtggcatctcttataagggctttgttttgttatctttcggcgtgccggatgacgttcaaacggaatgaagcttttataagcgccgctattgacgcgatcccgctttgatattaacctttgttcagtaaacaacacgcaattcggcaagggtgggcaggggcgaaaacgatatctgccaattgccgatttcagctattatgtttagaaaagggagtatgagatgaatacgatccaaaaaccgaaaatcccgaaagaattgccggtgctttctttcactgaagcgcttcaggatgaggagctcaaagaagtcatcattgaaaacggcatcgtaaacggcaaactggacggcctgcgcgccgaaaaagtcattttcagaaacaccgtttttacggatgtctctttcagacatatggaatgtacggatgtcctgtttgacaaatgcgatgtctcaaacgctgatttcagcggaagcatcatccatagaacggcgtttcagcattcaaaacttctcggcttgaatctggcggattccgccatgcgtcatgtacggtttgaagactgcctcgcaaattacagctccttcagctattccaatatgaagcatgtccgttttgactcgtgcggcctttcagaaagtgagtggaatgatgctgttcttgaatacacagatcttgacgtctgtgatttgaacggcgcaaacttcatcggcacgtctctttttaatatggatatcagcacgtgcacatttgatcatctgcacgtctcgcttgataagctgaaaggatgccgcatctctccgtctcatgccgttacattcgcagaagcgctcggcgccatcgtgacgtgattttttattaaacgaaaccgcggatacaggcggccggctccccggcatcctgaatcaatgctcggcattggtgatgtggggtgctgctttttattttgcggcgcttttgtttcgataaaaggaattcggccaggtcatgttgaatgtaccggaaggaagagggggaattggaatgtcagacattttaaagctgtatcactaccatagatgggccaatgagcaagttattcagcatctgaagaccctgcccgcggcaagcttacagcaggaactggatagtgtttttccgactttgaacgccgtgcttgtgcatatatgccgggctgattacacttggcttcacgtgctttacagagaaacttacgaacaaatcgtctcgcagtttgatcaatttgaaaagcttgacggagattttgaggcgattgaacatagaatgactgaactggacaaagaatacagcgaatttttaagagaatcggagaacatggaaggcccgatctccatttctcatccgcgcatgggaacgcttcggacgacatatgccgatgtgatccggcatattgtgaatcacggcacataccatcgcggcaatataagcgcgatgcttcaccaaatgggctataaaggcgtgccgactgactacatttttttctcatatgaattataaaaaagcaaaggcatgccgggcctttgcttttttacttcgaatctatcataatccggcatagccgggggcgcccggggtaagctttacaggccttccggttttaaaagattccgtcgcggcgatcccgatttttaagttaatcgcggcatcgatgtctgtcacaatcggcgtttccccttttttcacacattcggcaaagtgctcaagctccagacggtaagcgtctttaaagcgggcttgaaaatccggaataatttcgtagctgctgcctgactccgttaaaatggtgacatggcttttccgcagcgtgccgactaaaatgcttccctccgtcccgataatttccgcgcggatgtcatggccgtacggagaatttcggcttgcctccacatcgccggccgcgcccgaatcaaactcaagatatgttaatgcctgatcgacatcgccgcactcctccatgaacgggtgctttaaaatcctcccgtgcccgctgacagacgtaacctcggcattcatgagatatctcgcgatgtcgtaatcatgaatcgagcagtcaatgaaaagccctccgctatgtttgataaattccgcgggcggtgcgccttgatctcttgtaaatcctttataataaatgggtctgccgatttccccggcgtcgattcttcttttcgcgtcggcgtatgccggatcaaaccgcctcataaaaccgacctggcagatgacgtccgtttcttcgatttttttcatgacttttatcgattcctcaagactcagggtgagcggcttttcaacaaagatgtgcttgccgttttcagccgccttcatgatcatttccgcatgtgtgcttgtcggcgtgacaatgatgacggcgtcaatcgtgagatcttccagcagttcatacggattctccgtccatttggcgattcctaattctttcgcacacgcttccgccttccccttcatcgggtcacagacggccgcaagctcggctccccgcacttcgccggctaaatgcttcgcatgaaaataccctaatcgtcctaatcccagcaccgcacacctgacttgatctgtcatctatcaccgctccttttttcttgaggccgcatgccgtaatggcgcaagcggtttctcttattaaacagaaatcattattttgaaagcgctttatttacaactcaagctgtttgctttctttgcttgcaatccgcagtatttgcgcaagcgctttctcaaaagctgttttaattttacaatgcttttcgctcgtttgacaatgtttttcacagaaaaaaacgcgccttatcgctgagggcgcgtttttaccggtgccgtagaatgcctgatgacgagttccggagataaaatgattttgctttttgtttttttcttcccttgaatctcatcaatgagaagttcaacgacacgccgccccatttcgcggatcggctgagaaatcgtcgtgagcggcggtgccgtcatttcagcgagaatggtattgtcaaagccgatgacggacaagtcttccggcacccgaatgccccgggagcgcgccgcctgtatcgccgcacatgacaagacatcattaaaggcgaaaacggcggtcggaaggtctctgtcaaacagctcgcccgctgcctgttttccgctttccagcgaatattccgtcggtatgatcagcgattcatctagtgtcatccccgcttcccgcagcgctttttgaaaacctttgattctgtctctttcacccgtggtcgaaccgtttccgacgatacaggcgattctttcatggcctaaagatatgagatgctcagccgccgtatagccgccgagaaagtcatcgataatgacgacgtccatcggcgcgagcggtttatcctgcgtaatcatcgcaagcgggatgcccgatttcacaatatcatcaagcgccgtgacgctgtcatcatgatcaagtcccgtcgcgaatataatgccgtccgcctgcttctgccgcagcatcgaaaaatacttcgtttctttttcaggctgataatcggtgctgcagataatgatatgaaacccaagtacaccggcgctgtcttcaatgcttttcgccagttccccgaaaaacgggtttgaaatgtccggggtgatcaggccgatcatattcgtctttttgcccgtcaaagcggatgcgtgaacattcggatgatagtccatctcctccatgacacggagcaccatccggcgggttttgtcactgatcctccccgtattgttgatgacccgcgagacggtcgagatggagacgcccgctttttcggccacgtcgtaaattgtcattttcatgcttaccgatccctcttctgttctctggtattaggtcagtccgttttccggcttacgaatttgcggtattcaagcggcgaaatgccttcaatctgtttaaacagtttggaaaaataggttgggtcctccatgccgatggcgtccgcgatcgcccccattttgtcattggttgcggacaaaagacgtttcgcctccgtcattctgactttgttcgtatactggccgggcgtgacgccgagcacctgctgcatgcagcgggtcacgtagtcttggttgtaatgaagtgccgaagagagcgctttgatggttgttttctcctgatagtgctcctgcaggtaccgggcggcctcccatgcgactctttcctttgcggacgggatttggaacgcttctttctgaagatggagcagcagctcttcaaacagaatctgctttctgagcggcaggtcggagttctcggcgctttcatctgtcagcacactgaattgcccggccataaactgcgggcgtctcaccttccctttttgcggcagggacaagcggtagcgggacggctcttcaaagctccctttttttcgcctcagctccgaccagttgttcccggtggtttccgtcacctcataatccgctccttcaaaatgaagccacgaataggatgtcgtttcttcactgccttttgttccgtaatgttcaagcccgggagaaagcagaatatattctcccgcttcaacggaaaaggcgttttcgtcttctgtaatgtagaggacgccttctttcacatacagcagatcaaacaccgggaagacccgtctcacatgggtttcgccttttttgaacactccttctcccgcagcgataaagaccgggaacggagggactgtgaactcgagaaaggacatatttccggccctcctttttaagtcggatttttgcaagaagtttcgtttctctccctttttattataagaaaatggaggtacacttttaaacgttgattttttcaggaaaggggttaaaagaaatgaaacaagcgattttaaaacgggctgcattcaaacaatcctctgatcacaaactctcattatacgcgctgacttggccgatatttattgaggtttcattatatatgtttatgggaaacgccgacactcttatgcttagccaatactctgacaacagtgtggcggccgtgggtgtcagcaatcagattttaaatttaattatcgtgatgttcagctttatcgcaacgggtacgacaattgtgatttcacagtttttaggatctaaacagaaaaaagaggcgcaggaagtggcttatgtatcaataggagcgaactttgtcatcagtctcgccatcagcgccgccatattttttgcggccgttccgctgcttcatgtgatgggtctttccaatgaattgatgccggatgccaaagtctttttgcaggtggtcggcgggctgtccttcattcaggctttgattatgacgttcagcgccattttaaaaagctacggtcatacgaaggatacgatgttcgttacgatcgggatgaatattttaaatattggcggaaactttcttgtcattttcgggccgctcggccttccggtgttaggcgtcgccggtgttgcgatgtcaacgtcctttgcgcggatcatcgggctcatcgcgatgattgtgatcgtcaaaaaacgcatcggactcggtctgacatggcaaaagatttttcacgtccataaagagcacttgcggaaactcctgaaaatcgggattccgtctgccggcgaacagctgtcttataacatttcacaaatggttgtcacttattttatcgccattatgggcgctcaggcgcttacaacaaaggtttatacacaaaacatcaccatgtttatcctgctgttcggaacggcgatcagccagggcacacagattttgatcggcagatatatcggcgccaaacggtttgacgacgcttatgaccgctgcatgaaaagtctgtactgggcgcttggcattgccgctttgacatccgtgatcatgaccttgttttcaaagcagctgatcggaattttcacaagcagccctgacattattgcgacggcgagcatgctgatcgccatgacgatcattcttgagcccggccgttcatttaatgtcattatcatcaactcgctgcgggctgccggagatgcaaaattccccgtctacatggcgatgatttccatgtggggtatcggactgcctctcgcttatctgttcggcatccatttcggattggggcttatgggcatctggatttcatttatcgcggatgaatgggtcagaggcattcttatgtacagaagatggcggtcgcggatttggattcaaaaagggattgcataaacgccccgagcttcgttaagaagccgggcgtttttttatgcctgcgaaagccgttttctcatgtcaccgagctctgaccggtaatgtgccagcaaaccggtaacggcgggtcttgagtataacggaaacagctccagctcttcagacgcctcctcgaaatacgcctcggcctcgaatgcgatgtactcccatacattcataaaagctttgttgacggtatggctctccagctcttcttccgtatagccgaattgcatcatcacctggcgcgggagacgctttttcgaccactcatccgtatggaccctcagaagcacccgggtcagctgaatggctgctcctaatgaaacggctgcatggcggagtttctcttggttccggcgcgcgcaaaccggcagcagaagcaggccgagggctccgcctgtttggcccgcgtacatcagcaggtcatcaaactcttgatacgttactttttctctgtcagagatgtggccggcgataaactcacgcaacggctcttcttcaagtgcaaattgctgccgcacatcagtgagcgcctcccacaaaaagccgtcggcgcgtgccccgttcagaaagtcttgtgccgcctgttcaaatcccccaagttcctgcatatcaagccgatcagcttcgtgaaacaaagcaagcaccgcccatgcggcccgcctgttttttggcggcagggatgagaaagtccgtttatataaaggaaagtgcacctcggcaagatgggcgcatgtttcgtattcggtcatggtatcactcctctgttttttagtgtaccatatgtttcacaataaaaagaccgatatccttcagcggaaaccggtcgcggcactgttattcttctatatcgatacggtacgcctcaaaccatgtatggatctgggcaagatgggcgatcagctgcgggcctttcatcagctggccgaaccacggcacctgaaaagatgaaccttctgtctccagcagcatttccagcttctttctgtcaagcagggtgtgaagcacggaatctttctgttgtaaaatcgttttcagccattctgtgaccccctgcgtgtatttcgggtgatgcgttttcggataagggctttttttgcggtacaaaatatcttcaggaagcagtccttcaagcgctttccgcaaaatgcctttttcccggctgccatgcattttcatttcccaaggaatattccaaacgtattccacaagtctgtggtcggcgaacggcacccgtacttcaagacttgcgcccatgctcatgcggtctttgcggtcgagcagattggtcataaaccaaagcatatttaagtagaacagctgccgtctcgctttatctgttcccgtctcaccgtctaacagcggcgtttccgcaatggtttcttcatatctcgcattcacgtattctctaagattcagccgtttttgccacttttcatccaagagcgtgaccctctcctcagtcgacctcatccaaggaaatccgtcttcttctgccgcggtgtgaaaccacggatatccgccgaaaatttcgtccgcgcattctccggaaaggctcacgacaaaatcttttttaatttcccggcagaaccataatagcgatgaatcaacatcagccatgcccggcaggtctctgacgagaacggattcctccagatgttcaaccagctgatcctgcgtaatcacgcacttatgatgctgtgtgccgaatgcatttgtcattttatcgatccacgggccgtcatcattcggctgaaaggcgctcgctttaaaaaatttgctgttctcctcataatcaattgaataagtatgaaggggatctcttccttgtttctcaaaatgagcggcggctatcgcggttatcgcgctcgaatcaagcccccctgataaaaacgtgcaaaccggcacgtcagatacgagctggcgtgtcactgcatcctgaaataagtaccgaatgtgagcggcggtttcatcgaagctgtctgtatgcttttcgctctttacattccaataacgccatatggacaaaccgtcctttgagaaagtgaacgcatgggcgggacgcacctcgtgaattcctttaaacaccccgcagcccggagttctggacggcccgagtccgaatacttccgcaagtccgccgctgtctgtgcgggctttcacatcaggatgagcaagaatggctttcaattccgacccaaacagaaaggaagagccgtgttctttataaaaaaacggcttgacgccgagccggtctcttgccccgaagagccgctttcgcttttcatcccagatggcaaaagcgaaaataccgttcaagcggtccacgcactcctcccgccactcaatatagctgtgcagcagcacttctgtatcagaggtcctctcaaaacggtggcccctcgcctgaagctccttccgcaattcctccgtgttatacagctcgccattataaatgatggtgtacgtttcctcttgatgcgtgcaggccatcggctggcggccgccttcaatgtcaacgaccgaaagtcttttatgtccgaataaaacatggggctctccccagacgtttgaatcatcaggccctcgttttgaaagagtgtctatcatattgttcataatatgtttctcttggacgagctgcttttgaaaatcgacccaacccgcaattccacacatgtgatatcagctccaatcccgtttctgtcggtttcaaattcgtttctatcagcactttacccagtttatgcaaagaaacgcagatagttgatttgtcccactaagagttgtatgagacaagcccgatttggaaagaacggaagagaagaaacaaacaaaggagacgggcacggttatgaaacgaaaacagcttttctcagaaaaaaacaaatgggggcgcggcacactgatgatagaggacggcatctgcctcgtcgaaaacgatgaaggcgatatcctgcttgcagacagtctcggaaacgcagacgtattgatgaaacgcgacggcagatggcagccggcacggatttgcggcggttcggccgaaatcggcgcagacaccatccccctgctcggcggggaagaaatccgttatgaaaaggcggtcaaacggccgctgttaaccttgctcgattcgctggacgatgaaacgtttctgctgtttctcagccatctgcacgggttcggcctgtctgtatatgattgcgtattttcctataatcaggcgctgttttccggtgaaggcgtttcgttttatcacttctcggcggatgacgcacaatgcgccctgcagcatcaccgcggcagctcgggtaaacacgacagatttgaatggacggcatctgacgggcggcgctccattatgtattcagcggcaagacaagacggcaccgcgtaacaaacaggcggcaccttttaaataggtgccgcctgatgtattcagctttgtttttcacgctgattgacggccggcgtttgcttttacccttcacagccgtagcttttgcggcaacaagagtgattgacgcttttggcatcctggacatctctttcgcctcatcaacacggcatttctcattcagcggcccagttgcgcaactaaaaaaaacccggatgcatccgggtttttcaagcgattgattaaaatacgtgaaaaccgatcggcaagtgaaggcccagcagcaccgtcaggacgagcacgataataaaaccgatccacagtccgccggttgatttgccttttttcttgcggatgacgagcatttccatcagtccgatggtaatgatgccgagcagcatttttcctgcgtactctccgttccaattcgcaaaacggacaaaaagctcagctccggtcagaataataataatgtagaataagcgcagaatcatatgcgtaatttttgcgcccttcgcttttccggcaccgtacagcccgtagctgacaaacaccaggataagcgcaacgacccatgaagtaatatgccaatgtgtcattatgttcaattccccctatcagatcaatctgcctcatttatggtaccacaacaagccgctcggagcattatcaatcgtgcgaaagacacacaattatccgatttggttcgacagcgtgccgatcggttcaattgtaatgtcaatgcggtcccccggctttaaaaatttcggcggcttaaacccttttccgacaccggacggcgttcccgtcgctataatgtcaccggcttcaagcgtcatcccttttgacagcgtctcaattaattcagctatcggaaaaatcatgtcacccgttgatcctgattggcgcagttctccgttcacccgcgtttcaactttcaggctttgcggatcactgacggccgacttatgtacaatgaccgggcccatcggacatgtcgtatcgaggcttttgccgataaaaaactgtttatgttttttctgcagatcgcgcgctgtgatatcatttacaattgtatagccgaatatatgatcaagcgcatgttctttggagatgtgcgatccgctttttgatatgattaccgcaagctccccttcataatcaagctgctccgttacatccaagtggctgttcactgtttctccgtggcctgtaacggcagccggggctttcgtaaaaaccatgggatgctccggtatatccgcctcactccccatttcaacggcatgatcacgataatttttcccgatgcagatcacgttctttgaaggtctcggaataggcgcgcaaagctttacgtcagacagcgcatacataaatgaacccgactcgtcattcggttttttcgcccattccgcaagctgtccggcatgcgcgacgaacttatctcctttttgaatgcactcgatcagcgaacccggaatcgtctcaagttcaaacaattttttttcagccttttgcagatctaagattttgtcatcatcaataatcagaccgacaaattttcggctgttcagttcccctgttgcaaatttcatgttaatcccccatcatttttaaatggcattcctttatgtattcttcctccgggcgggaaatccctcttttaaacaggctgaaaataagtgtaaaagagtatcaaaaattgtcacttttttagtcatattgacgaaataaaaccttcttggccaaaatgggttatactattatcatcctatgttttccaaaataatcgagaattggagatcacacgatgaacaaaattgaagaaaaaagattaactttattcgagacagcgcaaaaattcggaatcaatgcgacggagaccatcaggtgcagccaggagctggacagccttttaaacgggtgccggggcgggctcatccaacaaacgaaagacagcgggccgaacccggccgcacagattcagcacggccgcgaaagaaaagaggctttctcataaacgtgatatgtatataaatctgtatcatttatgtataagacccggcatctgtaaagcgccggtgttttttacgtctaaagttttttccgctcacaaaaatgtgcatttgtcataagctattttaggcaggcagcccagataagctcctggagtgcagtcatgaaaatcttcacgaaaaggatgtgctcgtatgcccgcaattgtcggagcgtttaaaattaatgccgtcggtacgagcggagtcgttcatataggcgactgcatcaccatttctccaaaagcagaggttaagacatttgccggagcgggcagcttcaataccggagacaatctcacactgacgaattacaggaattcaacgaatgtgtacgataatgatgtaatcgatcagccgatggcaggaaacgcataaaggaggcgccgtatgaatttttacgtcaatcagtcgatccatatcaattacatgcgtgtagaatctgtcagcaattcctccatactgcaaatcggaagcgccggttcaattaaatctctttccaatctgtacaacacagggagttatgttgagccggcgccgcctgtcaccgcggggcagcaggctgtaacaacagggggaggtcccggcacctcatcatttgtaccgctccagccgccaagccggtagttttaatgaaggaaacgagacgcgaggtgaatgtcatgtatgatcaatccgtttcatcctacctgcagaatttaaattctttcgtccagcagcaggcgcagcagattcaggagctcgaacggcagctgaaagaattccaaaatgaaatttcaacgctgaagcagcagccttctacaagaatcgatcggctcgagtataaatttgatcagctgaaaattgaacggctggaaggaacgctgaatatcggattgaatccgactgatccgaatgccgtgcaaaacttcgaagtcggccagacatctccgcaggtcggaatgatgcagcaggaacaggcgggccagcaaatgcagcaaatccgtcaaaacgtcgatatgtacctgaatgaagaaatccccgcgcttttagagcagctcgaaactcagtatgagagcaggctggacgaaacgaacaaatatcatattattgaagatatcagaaagcagatggacagccggattcagtattatctgtcccatgtcccgaaagaagaaaatacggcgcccgcgcaatatgccgagcagattgccgaacatgtgaagcgtgatattgtcagggccgtcgagcactttattaaacacatacctggtgaaatgaaaggtgatgatccgtcatgatttttacagtgattaaccggaatattgaagtcggcgacatccggtctactggtgtatccagttcttccttattattaatcggcgacaccgattccgtctatctgtcttccatctttgacacgcctccggaatctcttattatcgggccttatgtgccgctggcgccggaataatgttaaagcgcatttcacgcctccggaacgccaaaatcaattcagtcgggattgcgagtgtctttcaagcaggcgatacgaatgaaatcaatatgcggatcaaagtattggccgatcagcgcagtcttgctgtatacagagatgatgaaggctcatttaacaaaaaagaataccagatctttcggcagccggccgtcatgccgttaccggaaacgggagtccaaagcgcattctgccatgaaaatccttcaattcgggtaaggaatgtgaaagttcaaggggtatcgtcagcgtccgtggttcaaatcggatcgacgtcggtcgttctgggagattcgcggctgaaacatattaggcagatcttcacgccaagctcacaatcacagcagccctgacatataatgacggtgagacttctataaagggtgtcgtttatgccagcaattaccggacctatagctatcaattccatatcgggcggagtcgtaaactttggtgattccttttacctttctccaaaaagctcttctaaatctgcgctcggttcgggagcaggcaataccggagatttcctgttattaaacaacgttgtcaatgcgacaaactatatagaccccgatgtcagcgatcaaaatgtggtcggaaacgcctaaaaagcagccgctctttcagaagagggctgcttttggttcagcgttattttcgttcatttgctttttttgtttttacaagcttttccggcggctgttttctgatccatttcacaaaccgcgcgagtttcgggtcacgccgcagctcttctattcccgcgagccttgccgcaagctcctgattcgtatagagcgcgtgaacctgtttatgacaagggatgcagagcattgcggtcggaaggaatgtcccgccttcttccttaggcgttaagtggtgctccgtcagccgcacataatggcggccgcataattcacatgtaccctcggcagaatcggccataattccttctcctttctacatgatctccaatgtgacccgggtgcctttcccgcccggttcggacggatgaacgattaattttttcggcagacgcgctctcagctcctgcacatggctgatcactccgacggataagttgtccgattgcagcttttcgagcgctgtgacaacggtgtctaagagcccttggtcaagagtcccgaatccttcatctaagaaaaagaattgcagcgggtattgcccccgcagctgaatctgggcggacaaggccagcgcaagcgacagcgatgtcagaaacgtctccccgccggaaaggcttgatacgggccgtttgacgcctccgttcgcgtcatcacgcatgacgaaaccgccttctgaatcgactaatatggcataccgctgccttgtcagcgctccgagacgggcagaggcgtcccgagccacgctttccagctgttcttccgctaaaaattcgacgaatgtattgcctttacatacagactggagcttatcaagcctgtcaatctgtgtctgccagtttttcagttcggcttcaatctctttaaagcgcttatgctgtttttgcataaccgcgaaggcttttgcctgtgctcctttttcctccatggcggcgcctgactcagcctctgcctgcttcagcagagaaacggatgctgtccattcttcctccgatatccggcgctcggctaatttatcagtaacacggctgatatttgccgatagctgttttgaggtgtccagaaactcatcaatttcttttttcatttcctctgcacgcccttgcggaagcagactttttttaacttggtccggttcggtaaacccggtgtcttttgacctcacgcgccagtcgttttgcgctttctcaagagaggcctcagcatccctgagtgacatgagactccctgattcccggccttttgcgtcattcagcgattgctgcgcctgcttcagcgcatcgaatagggactgttcttttgattttaacagctgtaattcctgccgcaccgcttcaagctttgcggaaattgatgtttcttcagctgctgttccgagctcttgttcatatccgtcaatcacctgctgcaggcgctcagacgcatagtgaagctcgagccgttcccgttcaagccgatgcttcatctcctgcaggcgttctttctcctcttcatgttccttgaggaatgcgatgcttgtttcaatgcgcttctcacattcttctgcctgcctgtccttctcatctatcgaagcctgccaggcgtcaatccggtttggcggaatatgaccgcagacttcgttgtactgattcaatcggctttctgacagcgattcaagctcttctaatgaatgtctgagacggtcggcttctttttcctcgtagcggattcgttcggcaagctgctcagcttgttttaccgtctgctgatgcgcgctgatcagtcttgcgaccttctcttttaccgacagcatatcctgtttcatttgtttccattccaagcggacggcgctgaacgcttcatcaagcgggcgtccgctgatggaagaagcggcttccagctccggaacccgggcgctttgcagaaacggacattcttcggtaaaacgccccgactgttcttctaatgcaaccttggctgtcagcacttcctgagaaagagccgccgcctcagaaagcagtgcttccacctgctgcaaatgttcctgcacagcggtatcaggcgagaatgtttcatgagcggaacgcgggcggtcatgctgcgtcgagccgcatacaggacaaggctttccttcgatcagtttttccgataattcttttgttaatgcagccgttctcgcttcctctgagcgcctgcggagatcggcttgcgttttttcagcccgttcggctgcggctttcagtgaacgttccgtttcacagaccatatggtaaacggtttgcagcgtttgataagcgcgcgtaatgtcttcctcttccgttttcgctttcgctgtgagcgactcgctttctccgttgagcttctccacgtttttcagctgcgttgtcagattggcccgctctttcgtgatttgttcctgtgtctgctgaaagcctgccgccagctgtgctgcggtctggcattttttccgttcatctgcggtcacttgaactgctttcagctcttctttcagctcattctgcctgttttggccgcgggtcaggcggtctttcactgcggccagctgtttcgaggcggcttcgtattcttcctcttttttgctgtgctccgcatttgttttttccgcttcttttttcgcttcaagcagtttttgttcaatggctgaaagtctttgatacagctcttcttccttgacaagtttcggctcctgttcggccttatgggcgcgccatgcttcataggcttcattttgccgggtaaatgaaacggtttccgcctctgatttccgtttggccagttcgtgttcctgttcggctcgctgcttccggcggacggcttcggtgcagcggtctgcgtacggctcaagggcgagagctgtttccgcctctttaagacgctcagtcaaatccgtgatgtacgggcgtctttcctcaagctttttctcccggcgctcatattcatctctttctgtctgcaagttccaaatttcctggtgattttcaaaacgctcttttgcccggacccgtttcttctcagctgcttcaagccgttcgttcgcttcgtgaaactgctgttcagcctgcttcagcgcatcttctcctgcgtctccgaggccggattgttcggccagcatttcattttttttcgctgccgcttcctgcgcccgccgccgcaattttttgacaagcctgtcccgtactgttccagattaaacagacgctggagcatatgtcttctttccgcgcctttaagcgacagaaactcggcaaactttccttgcggcagcacgacggctcttgtaaagtcgtcaatggtcaggccaagaagctcctctacctttttgttcacttcattcgctttatcggccagcaccgtttgttcgtctttgatttcaatcagccggcagagggcggtttttactttcgtttcatccgttctcttaaaaacgcgctcgaccttgtaggaaacccggtggccggattgaagcgcgaatgtaaatgagacggcaagctgatcttcggcatgattcagaatgccgtgcgtattatttgcggcgcgctccacttttccgtataaagcgagtgtcatggcatcaaggatcgacgattttccgcttccggtcggcccgaaaatcccgaacaccccggctcctgacagtccggcaaaatcaatggtctgttcctccctgaagctgtggagcccttttatcgttaacagaatcggcttcatgtcgcatcctcctcatcatctgctgacgcaagctctaaaaacagcttgaccatctcctcatccggcacgccgccgcccgtttgtttttcataaaacttcttaaatcgatcctcaattgatgtgtgtttcacttcaatccggtcattttcggtctctttttcttcaaaaaccggcctgatatggataaagccgggatgcgcctttctcagccgatgaatttcctcgagagaaagctgatccgtcaaatggatatcaagatcgatccaggcattccggtcacgcccttcatcaagccagccgtgaacctcgctcagcccctgcgctttccatttgacgagcggtttaccggaagacaggaaaatctcttcccacttcgcttctccgccgggcttcgcttctaccactgtcaccgatttggcataaccggcttccgaaaagctgtatgcgagcggagagcctgaataacgggcagccgtcttggcgcgcttgatcgtttgcggacggtggagatggccgagagccacgtaagccgcatcagccggcaggctgtcagcggcgaccgtgtaggcgcccccgacttcaatcggacgctctgaatcggtctgatttccccccgcgacataaatgtggctcgccgcgattttcacggcatcgttccggcacagtccgcacatgtgagcaaacgcctctctgattttcacatcgtaatgatcgcgaagaagcttttcctcaaacgtatcagaaagcacttcgtttaatctcgcctctgacggatatgccagcgcggctacggctaacagctcgtccgccgacggcacctcaatatggacgggttctgtccgcggatagccgattaaatgaatgccgcgctcatttgttaacggagaagccgccgccagcctgtcgggattgtcatggtttccggcaatgacgacaaccgggcgttttccgccgtcagaaagcgcggaaagactttcgtaatacaattgttcagcgagcgcaggcgggttgaccgtatcgaatacatcccccgccataatgaccgcatcaatgttttcttccttgacaatggtattcagctcttccagtacttcggcctgctcgctcagccggcttctgccttccagcgttttgccgaggtgccagtcagctgtatgtaaaatgcgcataccgcattcacctcactttttgatagaaaaaaagatccgctccaaaaaggagcttcggatctcgttacagtgtaagaacgtgacctccatcgaagaaatagagcgcacgccctttcactttcgtttttgtaatttgttcaaccgcttttgtatacaattcgatttgtgtttcatatcttttttgcagaatcggagccgcgccttcaaatccattccggaatttcccctctatccgatctgttttatagtccagcaaatagagaccgtccgcagtttcgtagaggcagtcaataatcccttgcacgagcagcggttcaccggccgtttcggcatccttgtacacctcgccggccggaagcgccatactgaacggcacttcccggtcaatccgcagcgccccgagaaggtctttaccgatttcagttccgaaaaaccggacaatttcttctatatcaatggcttcctgctgctcttctgtcagcagctctttttcgtaaagcatccggaccgtccgctctgcttcttcggcagtcggaatgtgcgtcagcggtatgtgctgcatcaccgtatgcatcgccgtccctttttcggcggctgtcagcccttttttcatcataaaaccgggacgcctgtataaaagcgtgtctcctgacggtttgatgagagagcggccgctgtattcatcctcgtactcttgctttctcttcagctcagaaactgactgcttcgttctgatagccgtcagctctcggtacggatattcccatttaagcagacggcgcgcctgatcatcaaatgaaaacgaaccaggaatcggctcgccctgctgtatcgccttgagacgtttgctcttttcttcagcacgttcttttggattctcttccagcaattcactttgctgcagcatccggatgtgaaaacgcgacgggtcgcgcgcgatatcctcagacgaagaaagtcccggcgtcctgtgcgcctccatgtcacggtggcggatgagcgccggcccgataaagtccaaataagatgacgcctgatagcggtcgaattcagaaagaagccaatcagcccggtctgcttgggcctgccatttggccagctgtttttcccggtttttgcaggaaccgacgagaaacagcttttccttcgctctggtcagcgccacatacaatacgcgcaattcttcggataagagctctctgcgcatctttttcttcatcgccacaagcggaagagtcggatagctgattctgagttccggatgaatatacttcgtgccgaaaccgagctctttatcaagcaggtatgatttgttgagatccatcatattaaaacttctgccgagtccagcggtgaaaacgacgggaaattcaagtcctttgctgctgtggatcgtcatcagccgaacgacatcctcctgctcgctgagcgcacgggcggtccccagatcatcgccgcgctcctgcatccgttcaataaaccgcaaaaagcggaataacccgcggaacgccgtcgcttcgtacgagcgcgcccggtcatacaagacgcgcagattggcctggcgctgctttccgccgggcatgccgcctgcatagtcaaaatatccggtatcgcggtatacttcccaaatcagctcagacaccgaatgattcgtcgaaaatgaccgccacttttgcagactgtcataaaaggttctcagtttttgatacagttcatcatgcctgtcaccgttcgctatatatgctttcagcgcttcataaaacggcgcttttttcttttcaaggcgtatcagcgcaagttcattttcgtcacagccgacgatgggcgagcgcagcacggaagcaagcggaatatcctgatacggattatcaatcaccttcaagactgaaagcgccgcagccacctccacggcttcaaagtaacccgacgtcaaattggcgtacaccggaatgccctggtttttcagctcttccattaattgcggcgcccacggcatggagcgcagcaaaatcacgatatcccggtactggatattccggtgtgtttttgttttcccgtcatagaccttaaacggagacgagacaagctttcggatctccccggctatcgctttcgcttcccaatgcacggtttcaaagtcttcggcatcctcggagctgtctgcgtcatcagcgctgtcaatcagcagcagttccgtttttgccgcgtcattcggcggatacgatgcgccgagcttcaatgccgcctgttcatcgtagtccacttcgccgatttttccgcccatcagctgcttaaacaagaaattcgtactgtccaaaatatcggaacggctgcggaaattttggttcaggtcaattttctgccccgcgccttccccgctttctgtaaaccttttatatttcccgagaaacagcagcggctcagcaagtctgaaacggtagatcgattgtttaacgtcgcctaccataaacagatttcccgcctcttcatccccgcttttcacaagctgcaggatagactcctgcacaagattggtatcttgatattcatcaaccagaacttcatgaaactggtcttgataataaacggccgcttcgctcggcacccgccggccttcttcatcaaccgcagttagaatcgccaggcagtaatgttccaaatctgagaaatcaataattgatttttcttgtttcgccgcttcaaatcgttttccgtacgatatcacgagctgaacgagcgtttcgatgacaggcttcatatctgttaaactcttcaagtgatcttgcggacttcttgtaaagtaatcggtctttaacttttcgatcagtttcttcgcgccgtttcgcaaatcggtcgcttcgtccaaaagcgctttgtcaaattcatcaccctttaccggcttcgcccgcttaaatgagactgcggggacccgttcatacagcgcatcgaagtcatgccggcagctgatcagctcttctatctgctgaaggtcatccagaaaattaccagcgcgcggggccggcccgccgggcgcttttgtcagttcaagcgccttctcaagcttttgttttgccccgaagagcgccatttccgcatcttctctcacatactggtaaaacggaagctcttccattttgctttcttccgtcacgtcatacaagcggacaaagctctgcagccacgcttccgggtcaggatgcgaccgggaatactcgtacacccgtttgacaaggtcttgaagatccagatcatgcctgtctgtcgtatatctgtctgcaagctcaaaaaacgcctgattcccttttgcgtattcatcttcaaacagctcatcaagcacttcgtctccgagcaattcgccttccgtctggtcagccatgcgaaaaccggggtcaagatcaatcatataataatattttttaagcacttgcagacagaaagagtgaagcgtcgaaatgctcgcccgatttaatagagagagctgccgtctgatatgcagagatcccggatttttggcgagctctttttctaatgcttcagcgatccgatgcttcatctccgctgctgaggcgtttgtaaaggtcaccacaaggagcctgtcaacatcaacaggatcttcctccgcggttatctttctgatcatccgttccacgagcacggccgttttacctgatccggctgcggcagcgacaagaatatcgcggccggaagaaacgatggcgctccattggtcatccgtccatatgctgtctttcggtttaggaatttgcatcatcatccgcctcctttttcagccaatccagtatggtgccgtctttttccgctttcaggctgcggtattcattttccttaagcgactcatcaaactggcaaaccgatttaaacgcacagtacgtacaaggcgtcttatctttcagcttatacggggtaatggacacaagcccgtccgttatcgcttcgcccgcctgttcaaatgtccgccgcacgtggtctgtcagcagatgaaagtcctgttcgctgaccgccgctgagtcggatcttaaagacccgtcctttttcaaaccggcattgacgatatttgaacgcccttcctccaaagtcgtgtccatcaggctgatcgcctcccggtcaccgaggagaaggcctttcattttaaatttcttgaaaatttcctgctcgatttcatcaagccccatcggcagactggcctgaatcatcggatcatggatatggaaatacaaaacgcctgccggggtcgctttcatgccgagccaatccgcagaatgtgtaatcgataagtcaagatatgtgagcatttgcagagcgagcccgtaatacacctcagccagatcaagccccctgtcgcttgatttataatcaacgattctcagcagcaggccttttgaactttccgctttatccacgcggtcgatccgtccgacgagttccatcgtacagccgtttttcagcgtgaaagtgagcggaggcagcggtccgcttccgccgaaaccgagttcaagaccgaccgggacgaaaccgctcgccttcgcatgctcgcttaatatgccagaaacacgcgtgacgatcttctgcagtttttccttcacgtaaaagtgtctgtttgagctgagcagaatctctttttgcagctttggcgcaagccgttccaccgcttcataggagaaattccggcactgatctttcgtcagatcgcgccattccagcttctgctcacgaagccggtctgaaatcagcttcagactggagtgaaacagctggccgatatccggcgcttccagcttgaaaaactgccgctcttttaattgcagcccgtgagatgcaaaatgagaaaactggcaggcattaaacgcctccatccgggaaacgcttcctttaatatgctcgccgtaaagctggcgcgaaacaggccgttcaagacgcttcgcctcattgcggaaaaataggcttgaaaacagctttttcgcacgctggtgatcagactctttcatcagcacattgtatgcgctccaccatacgtcactgatctcgtactctcttgtccacagcctgagctgacttgccgtatacgtctgagccacctgtttattgacgagatactgaagctgctcttcttcgcttacctgctcgggatcagccgctgacagcttttcctgatgatcgggaaacagctcgccaagcctgtttacaacgattgacggcaggagcgtttttccttccgcatcggcaatcgggtatgacacataaagacggtcagacggactcgacagcgccatatagatgagaaaatgctcatcaagcagccgctcacgccccgcggaagacagctccactccgaccgctttcagccactcccggtcatcatcagacagcacgccgttttcatccgggcgcgccggaagaacgccgtcattggccccgatgacgaatgtgcaggacgtgccgtatattcttgagagatccatattccctacaaatacttggtcaagcgcaggaggaattaaagaaaaatgaagcgattccgttcccgtttcaagcatttgctggaacagcgccaaagatatttcatcttcacccatcatgccggcaaactcctcgagaagctggataacggcatcccacgcctggccgtgctgctgcgcttcgatcatgtttccggcctcttcggcccgctgccttttccggtccagcttcaggggaacatcggtatcttccaaaaagagataaagagcctccgccatgctttgaaccgttttcgcttttttcatccggttctgcagccggataaggggtgcagctatccactctctcgtctcattcagcatgtgttccatctcgatttcctgatccgtctgcgcgaaatcctcatcgagcgatacgaagcgcctgtatacaaaccgctcgccgttcgtccagcgctcccctttaatgccgtaggcgatacagtaattttcaagctgatctacctgctctcttattttctgctccggctgatcaagcgggaataacagttcggttttcgcacagcggaacaccgcttcatatctccagttccccttcacgacatccaggcttgaacggatgaattcaataagcgggtgatgctgcatagaagcttttccgtcaataaaataaggaagcccgtaatcggcaaacacttccttcagcaaatctttataatcttccggctgacggatgagaatcgccatatctttgtaccggtatcctccgtcccggacaagcgattgaatttcccgggcaataccttcgagctcagctcttctgttttgcgcctgcatgacggtaaaagcttcctgtccgccggtatacgcggcggcgggacgcacatcgtactgcgactctatacaggcaagctccggcacatgccgatgccgcttcgtgccatgcagttccttgcaggaaatatcggcattcaattcctttgccgtctgataaagcttatagtatgtgcttcccgtcattctgaacagatcgagctcatccggtgcctgttccgccgaagggctgtccgccgtcagcgagaatgtgacatgttcagcatgcatgatcagctgctccagcacccttaattcctgcggcgtaaattgatagaatccgtcgacgtaaacacgggcgccttttacaacgtccgccaaaggaatctgctgagcgagcagcgtcaaatagtcctccgaatgcagatagtgtccggcgaggcttctttccatctgctgatataaaatgcctaagtcatgaagtttttcagacagcatccgctctccgcgatactctgacgccgttccgctttccgccatgcggcggacgtcttcaggctcaatacagtatcgcttaaactctgtcagcatccgttccacctgctcagtgaatccggctttgtcactcgctttttgatacactttaaaatcgtgcttatgttcttcaatcagtttccttaaaagcatctgcacacccgtcgtcgtcacaaacggacggttcatgcccccggtatgctgaagcacgcgccacgccaaacgcgaaaaactgaacacttgagcgcgtatcatgcctccgatatccggcgttttagcaagctcatattccattaaaaacgtcatttgatccgggactagaaaaatgatcggtttcccgaacggctcccggcgcagttcatcttgaatgctgtcgataatcagcctcgttttcccactccccgatctgcctactaaaaactcaacacccaaattagaagacccctctctttttatctttctacattttatcgaaagttgacgaaaatgaccaatctcatctgctggtaaaaacgggatgactgttttaaaacatatcgtttttgaccaaattaaagaaaaaaaggattaaatatgatgtcagaatatcccgaagtgattgtgcgaacgattctgtcgttcagcattctgtttatcggcgcccgtatactcggaaaacaaaccatttcacagatgacgctttttgatttcattgcggccatctcgctcggcgccatcacagccaatctgtcgtttaatacaaaactgccgattcattttactgtcagtgcttacacgatttttgtggttatcatttatcttgtcgcatatctttctatgaaaaacagaactgccaggggtttctttgcaggcaaaccgaccattatcattcaaaacggaaaaatacttgagcataatatgaaaaagatgcgctataccctcgactacttgaaccagcagcttcgtgaaaatgatgtatttgacatttctcaggttcagactgccatcattgaaacaaacggcagcatgtcagtggaggtcaaaccggaatttgcgcccgttacaagacaggatctcggcatctttgccggacatgaaaagaactttgccgttgagctgattatggacggccggctggtaatgaaaaatctggaagaaaaccacgtatcggaaaaatggctgagagaagaattggataagagaaacctcaaaccggaagacgtcgtatacgctgtgcgcggaagcaacggccggctttttgtcgacacatacgacgaccatattacatcgccgctggatcaagaataaaaatgacatccgcacatgtcacgggctgccgccgtataataccctataaacatccgggggtgagtccaatgcacgagaatttttttcattatacagccatctgcagtgacgattctgtgcttataaaggatctggtaaaatccataaacggtgaatacagcgctgtgatttgctactcaatattagccgaaaaagcgccgaccgcagaaatcagaagacgaatcgaacatatcagagaggaagaagtgcgccacatgcacgctttctcttcactgtatacgtcaattaccggaaaacagttgacgccgaaacagacggagcattgtccgcacacatacagagaaggactgagggcggcgttttatgatgagcagaaaacgaatgatttttatttacaggcatccgatagagcggtgcatccggaagcgaaacggttatttgcccgcacggcatttgacgagcagcgtcatgccgtctggtttttatacgatatggcccactctcctttccaccatacagggggaacggtatcaaactcgccgaacacaagctacaccgaggtaaataccggaaaataacgattcagacgctccccgctgggagtcatagacggcaaaccccgttctttcaacaggagagaatggggtttatttttcgagccgtttttatacttccactaaacaatggataacttcttcattgtatagtcagcaaaaaccctttataataaaataaaccaactggtcggttttaaacgaaccgagccccgctttgccgggacaacgatatgaatgaggcggaaaggatctgtgtgaagtgacaaatacaaaaggcggtgccggaaagagcgaaaagacgaagaacaggctcgtatccgcttcgcgtgacttatttgcaaaaaaaggatattcagaaacatcgattcgggatattttagaggcggccgagatcagtaaaggcaatctttatcaccattttaaaggaaaagagtttctgtttcttcatatcatggaagaggatcaccgcgtgatgatcgagacgtggagggaaatggaagctgatctgaaagatgctgccgaaaagctgacgggctttgcggagctgctcagccggatgagcatcaattacccgcttatgagagcaagtgaagagttttatgcgagtgcgtttacgtcagaggaggtcgtaaagcggctcaacaaaattgatattgaatatgacgatgtgatgagagagatcttagaagaaggaaatcaagacggaagctggtccattcatcatgtcgaatcaaaagtaaaaatcctgctatccgtcttctacggtttagatgtgttatataaaaacgataccattcagcaaagaatcgaattgcaaaaagaagccatctccgtgtttattcacgggtcgatcaacgctgataaactgaatgacagctgacaaaggagaaacaacatgcaaaaaccgatcagagaacaaaaggctgtactcatcatcttattaagcaacatatttattgcgtttttaggcatcggattgatcattcccgttatgccgctgtttatgaatgtgatgcacttgacgggcagcacaatgggataccttgtcgctgccttcgccgtcgcgcaattaattgcatctcccattgcggggagatgggttgaccgtttcggcagaaaaatcatgattctcgccggactgtttttgttcgcattatccgagctgaccttcggattgggcacacatgtctccattttatatttcgcaagggtgctggggggcatcagtgccgcttttatcatgcccgccgttacagcgtatgtcgcagatattacgacggtgcaggaaagatcgaaggcgatgggctatgtatctgccgccatcagcacagggtttatcatcgggcccggcataggaggatttattgccgatcacggcgttcgtatgccgtttttctttgcggcgggaattgcatttatcgcagtgatttcctctgtctttatgctgaaagagccgttaactaaagaagaacgcgcaaagcagatggaaagcgccaaagaatcaaccttcttaaaagatttgaaaaagtcgattcatccaagctacttgatcgcctttatcatcgtttttgttttggcattcgggctgtcggcgtacgaaacggtattcagcttatttacaaaccataaattcggcttcacgccaaaggatatcgccattattattacgttcagctccattgtggcagtcctcattcaagtgctcgcgttcggcagacttgtcaacttcctcggggagaaaaaagtcattcagctttgtctgatcatcggcgctgtgctggctttcgtttctacggtgatgtcagggtttttgcccgtgctcgctgtcacctgcatcattttccttgcgtttgatttactgcgcccggcactgactacttatctatcgaagatcgcaggaaatcagcaggggtttgttgccggtatgaactcaacatacacgagtttgggcaccattttcggcccggctctgggcggtattttatttgatatgaatattcacttcccgtttctgttcgcaggtgtggttttatttctcggtctgggattgacgcttgtgtggaaaggaaaagcgggcgaggtttcggagtagggtgcactcacccatctccggagctttttttatgttttcgataagaaaaatgaatggattatgagaaataattcattatttatttatctcaaaatctatactatagtaatagtaaggttaacgagcttaacaatttaatatgaatgtttcaggaagaagggttttcattgaagaaagacaaacatctccttacggatatctggtttattctcatcagtgcggcagggggtttcttctttcgcttacagggatgtcgatcgcctggatgctcggaacgcttgccgccggctgcatcctctccatgacgaggcccggctggctgttcatggcgcctgacagaagagggattcaccgcagatggcttgcggcgggacaaatgatcctcggcatcgaactcggccagaaattgaacctgtccgttctgtcggttttacgggagcattggcttccggtaggcttcatgctgattttctctatcgtgatggcgcttgtttccggatatgtgctctttcggttcagccggacggacatgatgacaagctttgtaggaacggcgccgggcggtttatccgccatgccgggtatcgcccaggaagtcggcgcaaacaccgcgattgtaagccttattcagctgacgcgcgtccttttggtcgtcatgacaataccgtttctcgtcattttcttatttaccaaacaaaacggtgcggctcagacatcagccggagccgtttcagcaggagcttcacatccgggccttattcccgtcttgttaacggccggatttattttagctgcctggcttgcaagtaaaggcgcaaaacggctgaaattccccgccccttggctgctcggcagcatgatcggcgttgctgctgcggaaatcggcgtgtccgccttggcgggcaaagacatgctggcctggtggccgccggaagcgaaccagctgtcacaaatttttctcggcgccacaatcggatcaaaaatgtacaaaagcatgttcaccggtgtgacgagagtgctgaccgtcggatttatttcttccgtcggattaatcgccgccatgattctgagcgcggttgcggtttctaaattaacgggcatctccatgattacatctgttctcgccttttctcccggcgggatcgccgagatggcggcgacttcgatcaccctgcacgaagactcgactttcgtcgtcgcggttcaggtcatccggatcgttctcgtcatcgccatgcttccgcccttctatcggctgctgcaccacctttctcagctgaaacgggcacacggcgaaagaggccgggcagaaagaggaacatgatccgaataaaaaaacacgcatccatatgcgtgttttttatttgaacagctctccgccgccatttacagaccgccagtttgctgacagatcacggaacagccgttcagcaaataacagttcttcatctgtatagcggtctaaaaacgccaagagccgctgttttatcaattcatgatattcatgatgaagggaatgcagctctttcccggcaggagtcagccggaaatagacttcttttttattgtcactcagccgggttctgcgcagaaagccggcttccaaaaacttcgcgcagcttctcgacacggtcggctttgtcgtcttcattttttccgctattgacgtgacattgatcggttcatgatctccgatacacgacaaaatgtgaatttccgtcaaggtcaattgtaattttttcccgtttccttcgcggagttcatccatccgtccggccaacgacgccctgatatcctcctgacacctctcctgctcgtgaaaaatatcggtcagcccttcaagaatcatgtgttttgcatggtctggctgtcttctgtccaactgctgagtcacccttccgtattgattgtttcttttactataacgttttgttacataagaaacaatcacacaggcgcataaaaaggttatcagatgaataatccccatctctccaaaccggccagaacggcttcttccgcttcacgtcccgagccgccggctgcccatgccgcatggccgtccggccggattaaaacggtgtggacgtcattccaatcggcacgtgtttcagcaagctccgccctgactgccgccacgctgtccgtatcaataccggcgggaatgctccctcttaatgacagaagcacaaagccgcccttgcggagaaaatcatacagccgggccggccgcccgtcatgaagggtcagttcgatatccggcaggcgttttccgttcagggtatgcggcggcagctccgcatccggttcataatgcagatcaagcgcggatacttttcccgccaataaacggttggactcctgaaaatccagcaaagcggtcatcgtttctcttaatgccatccccgactcggtaaaatccatgagctttatctgcgttttgatattgtgcagcacttcttttcctgtgctgtgcctttcctgatgatagctgtccagaagatgaggcgccgcttttcccttcatttgcgccgccagcttccagccgagattgacggcatcctgaagccccgtattcaggccttggccgcctgcgggaaaatgaatgtgcgccgcatccccggccacaaaaatccggccggagcggtactgctcagcctgacgctcggcattgccgaaccgcgacatccataccggatcactcaatccgaaatcagtgccgcatatccgccgcaggtcttctttcagctcatcttcggtgacccgctcttccttccgcttttgcgggacatgcggagaaacgatgaggacacggaaaagtccgtccgtaagagggataatcacaaccgatccctccagccggcacgttgaaaaaaaggaagattcgggcggatgtttcaaagcggcatcacaaagggttcctgttaagtcggcatcagtgcccgaaaaagcgatgcccgcctgtttccggacaatgctccccgctccgtctgtacccgcggcatataagctgtgaagagtgcggattccgctttcgtcccggaacaccgtctccactccgtcatccgtctgggtgacagccaccgcttccgccccgcggatgatgtctgcgccgagacttgatgcatactcctccaacatccgctccgtttctgcctgtggcagcattaacgaataattctgcttcgtatccagccgagaaaaatccagccgtgtatccagcatggaaaaatggccggaagacaccttcgtccctttttccaagaagcgttccaatatgcctctcatggcaaaaagctcaagtgtgcgcggatgcatgataagcgctttggaatacggcatcgtcttcttcaatcgttcaatgacagtcgttttcactccggccagcgccagttctgatgcaagcataagcccgaccggacctcccccgataatggcagcctgtgttttcatttcatcagccctctttcatatttttgttgcgcgcgtaacaaaaatatgaaaaataaaacacctccttttttgtttcgcgcgtaacaattttcattatagtctttcctccgctttttgacaatcatttccgaaaaaaagacgccgttcacttggcgtctgattcactgatgactccgacaatgtctttatccttaatcggaccgaaatgacggctgtcgaggctgtatatgcggttgtcgccaataacaaagtattgtcccttcggtatgcttttgcgcccggtcgtttccttcagcgtataatcaccagtcacatggctcccggcggacaatgatgactttaacggttttaaaaacggttccgccacccgttttccattcacatacagctgatcctccctgtatgcgattgactcgccggggagcccgatgacacgtttgatcagcactttgcggtgcgggcctttaaacagaacaatatcgaaacggcggatcgttttgtaacgatgggaaaacttgttgaccatcagctcatttccttgtttaaaggtcggattcatgctgattccttcgactttataatcaataaaaatggcattctttaattgtatggccaaaacaacgataagcacgccggctataaaccaaaatcgttttttcaagattcctgtctccctccgtctttctcatgctgactgattctcgtctgtaaacgccgttcgatatgctttccggcataccacagcaccgcgatcaccattatggcgcccgccatcctgaaaggctgtgtaatgagtgcgtgaagatcatacccgataaaactgatcataaagatcataaccattttccccatcgcggctgctgatataaactgcagcgcccccacccgtgacagaccggcaacgatatgaaccgcagcggacggcgtaaaggggaagcaaagtaaaataaacagcggaccgaaaccgtgccgctcaacccagagcatcatccgccttatggtctgatgcctgcggatgaaaccgaaagctcttttctgtccgaaacggcggacggcataaaacatcagcatcgatcctgacgcagacccgagccatgacagaaaaaaaccttcccacaaaccaaatgcattcgtattcgccaccacaaatacaacgagcggcaaaaacggaagaaacgcttcaataaaaggcaatacagccgcagccgccgggccgaaagctctatagctttggaaccattccgtcagctgttcctcagtcaaatatgataaaaaatgctccaacgtttatactccttaacgagtttgtctatccttattctacacattatctccaaaaaacgaaaatgtttacgagattttccgtcttgaaatatcgtgtaagcgagtataaaataagaacaaacgttctcttttttaagaaagaaggagtatttatgcctgacattcggagcggcacccgcgatctcatcgaaaaagggctgtttctgcccatggcggccgccatcctgaaccgggacctcgaagcgcttgattcgtgcccgttcaaattaaaacaaccctataaacagcttatcagctgctctttaaaattagcacaaaaggatttgagtgatgttcgaaaagagttaagaaagcgtaaaattaaaatatacgaagcggaaagagacgaagcatttacgctttatatatgcaccattaacggctatgaagaaaaacaccgttatttcaacccgagaatacgggaacaggtcaccgccttattggaatattacctgtctcttgcgaccatttaaaaagcagccgggcctgcttttccttttcaaaaaataaaattcagactattcacactatacattcgacatgattttctttataatcgggacacgctgttttcaatgaaaaggaggaatgttatgaaactgattcatgttctcgccgccctgccctttttcggaattctcgccggcattccatttgccaaccgggtgacgccttatgttttcggaatgcctttcattctcgcatatgtcgtcatctgggcggtgctgacttccgttctgatggccgccgtttacaaattggacaaagaaaacaaggcgggtgagacggaatgaatgcagcatttcccgtaatggccgccgtgctcctgttttgtgtatatctcggaatccgggcccgaaaaggaaaacatatggaccttgaacaatggacggtgggcggacgcggcttcggcacgatgtttgtctttttattaatggcgggagaaatatacacgacctttacattcctcggcggaagcggatgggcttacggaaaaggaggccccgccttttatattatcgcgtacggctgccttgcctacattttgtcatattggcttctgccagccgtgtggacttacgccaaacaacacaaactgatgtcgcaatcagattttttcatttcaaaatacaacagcccgctcctcggcattctcgtatcgctcgtcggcatcgcatccctcatcccctatctcgtcctgcagctgaaagggctcggattaattgtttcagcaacgtcatacggacagattccgccctccgccgctgtctggatcggcgctgtctccatcacgatttatgtgatgatttcaggaatccacggttcagcgtggatatccgtcgtcaaagatatcatgattttaggcatcgtcctgtatttaggtatttatctgcccattcattattacggcgggtttacggagatgttcaaacaaattgacgccgcaaaacccggttttctcacgctgccggaaaccggacagagcgtttcctggttcagctcaacggttttgctgaccgccctcggcttttatatgtggcctcatacctttgccgcttcctattcggcggagcatccgcgggtgtttcggaaaaacgcgatcatcatgcctctttatcagctcgtcctgctgtttgtcatctttaccggatttgcggcgattctgcaggtgcccggtttaaaaggggcggacacggatctcgccttattaaagctgtctgtgaaaacctttgatccctggtttgtcgggctgatcggatcggcgggcatcctgacggcgcttgtacccggttcaatgatattaatggcctcaagcacgctgttcgccaaaaatgtgtacaaagccattctgcccggcacgactgacgaaaaagtctcacggctcgcaaaatacgccgtacccgttatcgcgctgatttccgtatattttacgctgaaaggcggaaataccatcgtcaccttgcttttaatgggctacagccttgtcacccagcttttccccgccctcttattcagcctgccgaagcggcgtttcatcacaagccacggcgcttttgccggcataacggccggggtcggaacagtggccttcattacgctgaccgaatcaaccgtcggaaccctctttccgtttcttccgcagatcattaaggatatgaatacaggcatcatcgcgctggttctgaacattgccgtcatgtttgccgtcagcgccgcagtcagaaaaaaacaaatcagcgcagccgaaaaggcggcttaatgataaaatagcggtaagacacatgaagggggaaagccgcatgatcatgacaacgaccgaaaccgtcgccggaaaacagattacggaagtaaaaggcttggtgacaagcagtatcgtccagtcccgtcacatcggaaaagatttgcttgcaggcttaaaatctgtcgtcggcggcgaattgaaaagctataccgaaatgctggaagactccaaaaaagcggtgaaagagcggctgatcagagaggcggagcagctcggagcgaacgccatcgtcggcctgcggttcgaactgaccgcaggacagaacacatccgaattaatcggatacggaaccgccgtcaccgccgaatccatttaaaaaaacaagcctctttagagaggcttgtttttttatttctcacatgcgatatagtctttatcccggtcaagtcttttatttgcattataaagcgcttttgatacatacggcttgtactttgttctgccgcccttgtttttcactttcgacgatttggccacgccgcccttatacaccttattcagcgccttacagttttgatacgtttttacctttgttttcgcttctgccgtctgccccgctccgtatgaacaaccgaacaccaggccgaaagacaaaagcacagctgccgtctttttcatttctatcctatcccctttcctgaatcatgttgtatgactgaacatatcatagttcaaataatctccatttacaagataaataggaaaatagttttaatttacgtccgcccgtatatcttttatggaatttttcccaaaaccttttataatatgaattgatagcgctatctgactatgatgataggaggagaaatgatgatgaaaaaagggcttgttgcgggtgttctcactacagccgttctattcggcgcatgtacggcggatattccgggggtgatcagtcccaatacggcggaagcggcgtcccagctcagtaaaggaatcggcggaagggcctatctgaacagcacgggctcagttctcgtcacgaaaattcagcttccaagctcgattcaggtgtcaaatgggacagcctatatttactcaggatttaccggaggcacagaggctgatatcgggcttcagtacagtgacacctatcatgtatggaaaccgatcatgaaagtcggttcaaagggacaaggccaggtccggtatctggaaggagaaagccaattcacttatacgaaaggcttccggcccggcagcaccgtacagctgaccatttacaaaaatctgaacggcaatacccgcgccacatattggggcacgaataatgacggatacaccggccgcatcatctcagaactcgcccaaaccaatgtaggctctgtctcaaaatggaaagcgctcgccaccgtcgcggtcacatcagaggatcagcgcccttacatcaaatcaaacttctcgacagcctttacgaacatcacgatcgacaataaagcagtcacacctgtgattgatacacaggattttgccaaattgacagtgtcaggcagcaccgtcagcatgtctgtcgtcaaataaagaattttgaacgcacgatttctttcatcgtgcgtttcgtaagggtctgccggatacgcaaatcccttatttttcggattacgtttaataaaaaaacagccctcctcagggttgtttttttaacatttctttcattatttccgccaaaacgctgagcagtccgccttatccttgatattaaattgaatcatgcgttcaagcagctcataatacaccggttcagtccattgaattctgaacaaacgggaagtagcgctgtagccggcacgggcaatgtcgtcggcaaaatgcgcaattccagcttcttcgggagaaacacttacatgatgctttgctgccgcaaagccgataataaaggtgccgtgatcggtaaacatcggcgtgttccacttgatctgcggtgttaaacccgggaattgctcagacgtccacgacaggatttcctccattcgcagacgatggtcagggctgtcgatacttgataaatagtctttgaaaacgtccatgtcttcctccttcaacatcacgtccgctaacgccaaaaccccggattttcagctttttctttgatgttaaattcgatgatcttcttaagcagatcatagtgcaccggatcagtccaccgaattctgaacaggcgtgaagaagcgctgtacccggcttgggcgatgtcatcggcaaaatgctccatcgtctctttttcaggtaaaatgctcaaatgattttttgccgcggcaaacataatgatataggtgccgtgatcggtaaatgtcggtttgttccacttgatctgcgcttctaagttcggaaattggtcagccgtccacgacaaaatttcctctgctttgagacggtgatccgggttatcgatttctgatacatattttgcaaacacatccatgcccatctctcctaaaatgaaatatcattactctttacatcatcatagccaacagacggacacgatacaactctatccgggcatgtaaatcgaaaaagcccttcccaaaaggaaagggcccgtccctttacatcacagctttctctaatatctctcccccagctcccgcaaaataaagtcgtagatcattcttgtccgctcttctttcggatacagcatgaattcctgccgcttcgggatatgactgcccatcctgtcctgaaaagtggttctgagataggcggttctgtaaacctgattttcaaaagaatgataggatacttccagttccatcgttttgccgtttgagaacgtgaccgctgtgtcatcaaatgccgtcggttgaaaatctttaacgtgcacatgagatatccagccgcattgaggccttgcagaagaaagtgtagggaataaaaagatgtgatttgaagggtccaccataatcggcggcttgtgagaaattttaatcgcttcatatgttcccgcttttctcccggcatagctggagccaaagtagcggcagcttctgtcgatgatgtgaatcggcttcatgctgacatacagaatgcagtctttttcaatgaccttcgaccccattttaccgtctatttcctcaggcaaaacagcgatggttgaacgatttacttcgtagctttctaagggtgcgtgtgttttctggcacatgatgtgcagcctccaatccttttcttgaaaatttatactaataatctatcatctgtaattggaaaacgacaggttttttttgaatatagctaaaaatcaccttttaaagctgtaatttagtcttaaattactatttaaatattatttttctttttcatttcacctcatttatacaatgatcattttcgttttttcgtcaatttgcaggatatgtcgatatatttccaagtattagttatctaaagattataaaaattaattgatttttccggccgttatccatatactataaaaaaggcattggggggattctttatgaaagagaaaaagtcgtacactgagctcatgaagtcccgcaacacggaaaaagcaaacgaattcgatgtgacaatggccgatatttacattcaaatggtgcttgatgaatccttgtataaacgccggatcgccatgctgacaatgcagattaataaggcgcttgatgataaaaataaagaagcgttcctcacgctttcaaaagaatatgccgctctcaaacagagtgaataagccaatccatatggattggctttttttacattatccgtttacgatggtgccgccgttcacatgaatcgtctgtcccgtgacataggaagaatcatcgcttgctaagtacaaatagctcggcgccacttcaacaggctctcccgggcgctgcatcggcacgtctgagccgaagacttccacttccttcgccgagaagctcgccgggatcagcggcgtccagatcggccccggcgccactgcgtttaccctgatgccctgagtgacaagagattgggaaagagatcttgtaaacgtgacgatcgccccttttgtcgctgaatagtcaatcaatgttttgtggcctttataggcggtaatggaggccgtattaatgattgaacttcctcttttcaggtgagggagcgcggctttcgtcaagtaaaacattgaaaaaatattcgtctgaaacgttctgatgagctggtggctcgtgattttctcaatccccggctgcacgtgctgctcacccgcgttgttgaccaggatgtcaatggaaggaaaggcttggcccgcctggcggatgacatcgttgcaaaaggcttcgtcgccgacatcccctgcgatcagcagacacttcgccccttctttttctacatattgcttcgtctcttcggcatcctgatgctcatcaaagtaaacgatgaccacattagcgccttcctttgcgaataaaacggatacggcgcggccgatcccgctgtctccgcccgtgatgatcgccgttttcccttcaagttttttcgccgctttcggtttgtcaaaaacggggcgcgggtccattacatattcaaagcccggctgccggttttgatgctgcggcggcaaggttttcttcttctgattcgccattttgatcactcctttacattaattactatattatgagtaatttgagcatcttatacgaatttcatgtatgaacagagtcttattggaaaaattaagaatatacaacagaggaggtaaatctgaattgactactttttcaaacgaggaaccggcttcctattggaaagcaacagctgacattccttcctttcccgccctcactgaagatacggaatgtgacgttgcggtgatcggcggaggaattacgggcctgacaacggcatacgaactgacgaaaagaggtttccgtgtcgctgtcattgaagcagaccggattttaaacgggacgaccgcgggcacgaccgcaaaaatcaccgcccagcatgatttcatctatgccgatcttattcagcagatcggcctgaccagcgcaaggctgtatttcgaagcccatctccgcgccatggaagacatgaagcagatcatcaaggacctttcgattgactgcagactgattgaacaagacgcatatctttacaccaatacagaatcaggcgtcaaaaaaatgcgcagtgagcaggaagcttataccaagctcggtattgaacacgagcttgtgaaagaacttcccgtccccgttgattgcaggctcggcctcgccatgaagaatcaggcgcaattccatccgcttttatatggtgcggcgctcgtcaaagagatcgttaaaaacggggcgcggatttttgaacagacggctgcgatcgacataaaaaaagaaccgcagccggaagtggtcacgaaaaacagacacggcatcaagtgcagctacattgtctgcgcttcccactttcctttttatgacggaggcgggctttatgccgccagaatgtatgccagcagatcctacgtactcgcggtaaaaccgaaacaagcgtatccggacgggatgtatctcagcatagacaagccgtccagatcactgcgatacaccgatttgaacggtgaaaaactggtgcttgtcggcggtgaaagccacaaaacaggccaaggaaaagaaatgtccgggcattacgaagcgctgaaacaatttgcggaagacacaatcggagttgaaagcatcccatatcattggtctgcacaagaccttgtcaccattgacaaaattccgttcatcggtccgatctcaggcgatgaagaacatattttggcggcgaccggttttaaaaaatggggcatgacaagctcagcgctcgccgcgaagcttttggctgatcatattcaaaacaaaaagaacccgttttccggcctgtttattccgtcacgcttccacgcagatcccggactgaaaaaactgatttcctataatgccgacgtggccaaacaccttatctcgggcaaacttgagaggccggacgcttcgcctgagagtcttgggcccggggagggaaaaatcgtaacggtaaacggcaaacgggccggcgcctataaagatgaaaaaggctgtctgcatcttgtcgatacgacatgcacccatttaggctgtgaggttgaatggaatgacggcgaacggacgtgggactgtccatgtcacgggtcccggttcacacccgacggcggggttgccgaaggtcccgccatcaagccgctgaaacgtctcacccaagattgactaaaccattctgtacgaatggttttatttttttccgcattaaaatatttttatcagattccttcattcaagttccttccaaaccgataaaaagaaaaagagaatatctgggggaactaatattgttatttaaaaaagaccgcaaaaaagaaacagcatatttttcagaagccgatggaaaaaaacgcatcgcgctttcaaatcaatatgcagatgtccaaaaacagctgaaaatggtcaggctcggaaacgaagaacttcatgtgcttgaagagctgcagccgttaattaaagaacatatctcaacaatcgtcgattccttttaccgaaacctggatcacgaaaaatcattaatgacgatcattaacgaccacagcacggtcgagcgcctgaaaaaaacattacggcgtcatatccatgagatgttcgccggcacaattgatgatgaattcattgaaaaaagacagcgcatcgcttccatccacttgcggatcggccttgaaccgaaatggtatatgggagcgtttcaggatctgcttctgtcgatgatgaacatatatgaagcaaccattccggatttgcatgagcttttaaaagcgatcaaagcgacgacgaaaatattgaatcttgaacagcagctcgtccttgaagcattccagactgaatataactgccagcgtgacgaacaagaggaaaagaaagcccgtcttcatcagaaaatccaggaaacatccggatcactcgctgatttgttttcagaaacgagcagagccgtgcaggagctggtcgataaatctgagggcatttccgaggcgtcaaaagccggcaccgtcacttccgtacatgtcgaagaaaaatcaatcggcgggaaaaaagagcttgaaagccagcagcagcagatgaataaaatcgacgccagccttctgcagattgaagaagaaatggacaagctgaatgacatcgcccagcagatcgaaaaaatcttcggcatcgtgacggggatcgccgagcaaacgaatctcctgtcactcaacgcttcaatagaatccgccagagccggagagcacggcaaagggttcgccgttgtcgcgacggaggtaaggaagctttcagaggatacgaaaaaaaccgtttccaccgtatcagagctcgtgaacaataccaatacacaaatcaacatcgtgtccaaacatattaaagatgtaaacggacttgtaagcgaaacgaaagaaaaaatgacgcagatcaaccgtctgtttgatgacatcgtccaaagcatgaaaacgagcaaagaccagacaggcaaaatcgacgttgatttgcaggcctttctcggcggccttcaagaagtcagccgcgccgtttcccacgttgcatcatccgttgattcacttgttatccttacagaagaataaagataaaccgaccggcctttttcataaagggccggtctttttaatgttaacttaaaatataatagagttgacatatataaagactcgctttattgtataaacatattttgataagctggaggaatacataatgaaattgacagaaatgatgcatattgccgtgtttaccgccattatgggacttttggggctgcttccgccgcttttcttatcctttacgccggttccgattacgctccagacgatcggtgtgctcttatcaggaagcatccttaaaccgaaagcggcatttttaagccaattgctttttttgctgattgtggcatgcggagcgcctctcctttcaggcggaagaggcgggttcggggtttttttcgggccgagcgccggatatctcatcgcatatccgctggcggcattactgctgagcctcagcatccaaggccttcgctcagctgctgtcccccatttgtttatcagacagttcttgttcggcgtgctgtttttgtatgtcatcggcattcccgttcaggcttttataatgcacattgatatcttgactgccgtaaagctcagcctcatctatgtgcccggagatctgcttaaagcggccgcagcctcattcgcagccgtaagaatcagaaaaactcttcaagcaagccggcttttgccgacgaaaggaagctgattttagtcatcatgattacatcatcatattcagatacagccggacaagcgccggaacggatcgcaattcagacagacacagaacagatcacctatcaaacttggaacaggctagtaaaccaaaccgcaaactggcttggcagcctttcagataagccggaaaacattgcaatattactgccgaacggcatcccatttttacaacttttcgcaggggcggcgcatgccggctgcacggcggttccgttagatccccgctcggctgcggcggaactcgcggaccagctgcacatcagcaaaaccgacctcgtcatctgtgaccgccggctgagcggcagactggacggcatcaaaacgcctgtcatcctgtgggatgaatgcgggcctttgatcgaggcggaaaaaacggaaggcacttttatcaaaaacaccggcctgcccttttataccggattcacctcgggatcgaccggtaagccgaaagccttcacccgctctcaccgttcgtggctggagagcttttcttgtacgaaacgtgaattcggcatttcccctgatgacaaagtgctggtaccgggcacgcttcgctcgtcacactttttatacggcgccgtcagcactttgtttatcggcggaaccgtcctccttcaaagaaaattcaatccggccggaatgaaagaccggctcagacaagctgacgttctatataccgttccgacaatgacggacgccctgctctcactagaggcgtttccggatacaccgctcaaggtgatttcttccggtgcagactggcccgcttcgtctaaacaagcgctgtcagagcgctatccccatttacggttgtacgatttttacggaacgtctgagctgagtttcgtggcgttcttatcgcctgaagacagcgcccggaagcctgacgcggcgggccgtccgtttgaaaatgttacaatcgaaatccgccggcccggcggggaacgctgcatgccgggcgaaacggggaagatttttgtgaacagcccgatgaaattttccggatacatcaacggcgcaaaacctgatgattccggctggatgacggttgatgacatgggatatatcgatcgtgaaggctatctttatatcgaaggacgtgaaaacgggatgatcgtatcaggcggcctgaatgtattcccggaagagatagaacgtgtgctcaaccgctgtccgggcgtcagaaaagcggccgtcatcggcattcctgatgattattggggcagcatcgccgttgcggtgatcgacggacatgcaaatgtaaaggaactgaagaaacagtgccgcgagcagctggcggcatataaaatcccgaaaaaatggctgttttcagaaataccggaaacagccggcggaaagatcgcccgtgccgccgtacaaaagcaggcaaaggacatgatggaatggaagctgtaattacggatgcgaagcggacgattttcgcccgggaaaacggcctgttaaaagactgtctccccgaagatttggcagctccgctgatccgacatttgagccggaacatgcccgaagacattgatgaagtcctgatcggaaacgcgacgggccgcggcgggaacctcgcccggctgtcagccttggccgccgggcttcctttgagcgtgtccggtacgaccatcgacaggcagtgcggttccggattggacgccgtgagggtcgcgtgccactttgttaaagccggcgcggggagcacatacatcgcgggaggagcggagagcagcagccgttcccctttctcatcccgggcgcgcttttctcctgaacacatcggcgatcctgatatgggcatagcggccgagtatacggcacaggcttacggcgtaacgagaaagatgcaggatgaatatgcccttctcagctatgaacggagcgtcaaagcgcacgaagacggcttgtaccgccgggaaattctcccctgtcacggattcgccgctgacgaaaacatgctgaaaaagcggaacatggggcctctcatcgcccgcgccaaacccgtctttcagtccggaggctctgtcaccgcggccaacagctgcggaatttctgacggggcggcggcagtttgtgtgatggaagaacaaaaagcgcggtctctcggtttaaagccgggattgcgttttatcggaagcgcggtaagcggcgtccatccgcattatccgtcagcagctccggtttatgccgtcaaaaagcttttgaaggaacgggacctgtcaccggatgatattgatatatacgaaatcaacgaggcgtttgccgtcaaaatatgcgttttttcacagcagcttcaagtgccgtattctaaaataaatgtccggggcggcgctctggccgtcgggcatccgtacggggcttccggagcggcgcttatcacccggcttttttatgaagcaaaaagacgcccggatgcccgctacgcagcagcagcgatcggcagcggaggcggagtcggactggcgcttctctttgaagtgttaacgtaacggcagtataatagatgatatcgataaaaaatgatcggagtggagactttatgactgccgtttgtttagtaagacatggagagactgattggaatgcccaaaagaagcttcaaggcaaatcggatattccgttaaatgcgacgggagagcgtcaggcgaaagaaacaggagagtacttaaaggggtccgaatgggatgtcatcgtctcgagcccgatgaaacgggccagaaaaacagctgacattattaacgggtttttgaatcttcccattgtcgtcatggaagatttcagagaacggagctacggtgatgcggaaggaatgtctttgccggaacggtcgaagcgctacccggataaaaactacccgaacatggagaccgcagaagagctgacagacagaatgcttgccggtttagtgaaagttcaggagcggtttcctgatcaaaaagtactgatcgtcgctcacggcgcagctattcacgccctcttgtccgctatttctgacggtgataccggcatacaaaacgcaaagcttgtcaatgcgtgcctgagcaatatcgaacgaattgaaaataagtggcgcgtcaaagattacaatgtaagcagccacctatcagaatcataacaaaaaggcccgaattagttttgggcctttttggcgagcatttttttctgaagatcatgtaatacggcgtccgcaccgtcaatgctccggcgctccgtccataccgccctgtccgcgcggtaaacgtgtccgttttttacggcagtcagctgtttccagaggtgatttttttcgagttcttcctcaccgtccaatagtacgatgtaatcaggatcgatatgcaaaagctgcccgggcctcattttgatagcgtctgatttcccgccggaatccgtctggaccgcatatgtaaaccctgcgagcgtcaaaagccgggatgtgaaaaaccggtcatcctttacggaaatgctgccatttgcagcgtcaattaataaaatcgtgccgccttctgcatccagctttcttttgatgtcattcagcttttcttcctgagccgacaattgtttctctatgatgccctctttaccgaccgccttttcaatggtaagggcagcatcaaccgcatcctgataatccgcagcttcatttttcaaagcgattgtcggagcgatctttgtcagctcatggtatatcccctgtgcaggcttgagtctgcaatgatgagatcgggttttaacgaagtgatttttttcaaatcgggatgtgacgggggcccgacggacggactgccgtcgtttcgctctttccggttatccgccgcggccgccggctttataccgagatcatggagggtgtcaataaagccctcattcaatacggcgatgcgctgcgggtgcgcagccacatgcgccgtccccagatcatgcctgacggcggtttcatgttcctgttctgagcatgccgttatgaagagaacggataagatcatcagcatactgaaaattggtttcatctgttccccctctttcgtttttccgcaattatatcattgacaatataagtatcaatgatattcattatcattatttttataaaatggtttcacagcttttctccctcaagaaagtcaaagactgattcatgccggccgctttatttcattccgctttcgtttccatcagacttctgcattcaacaaaaggtgacatttatcctgtttttgcctcagcttccaaaaatggaatcaaaccgttcgacccagtaaacaagagagcgattgcggctgtgtacaaatactcatgtccttccatcggttttttccattaaaatttaaatatttcgggttcctattaaacgaaagagagatgatatacctaaatagaaataaaacaaactgaaaaaaattgggtctactaaaatattattccatactatacaattaatccacagaataatctgtctattggttattctgcaaatgaaaaaaggagtggataaagagtgagaggcaaaaaggtatggatcagtttgctgtttgctttagcgttaatctttacgatggcgttcggcagcacgacttctgcccaggctgcagggaaatcaaacggggaaaagaaatatattgtcggatttaagcagacaatgagcacgatgagcgccgccaagaaaaaagatgtcatttctgaaaaaggcgggaaagtggaaaagcaattcaaatatgtagacgcagcttcagctacattaaatgaaaaagctgtaaaagagctgaaaaaagaccctagcgtcgcttacgttgaagaagatcacgttgcacaggcgtacgcgcagtccgtgccttacggcgtatcacagattaaagcccctgcactgcactctcaaggcttcaccggatcaaatgttaaagtagcggttatcgacagcggtatcgattcttctcatcctgatttaaaggtagcaggcggagccagcatggttccttctgaaacaaatcctttccaagataacaactctcacggaactcacgttgccggtacagttgcagctcttaataactcagtcggtgtattaggcgttgcgccaagcgcatctctttacgctgtaaaagttctcggcgctgacggttccggccagtacagctggatcattaacggaattgagtgggcgatcgcaaacaatatggacgttattaacatgagcctcggcggaccttctggttctgcagcgttaaaagcggcagttgacaaagccgttgcttccggcgtcgtagtggttgcggcagccggtaacgaaggcacttccggcggctcaagcacagtgggctaccctggtaaatacccttctgtcattgcggtaggcgctgttaacagcagcaaccaaagagcatctttctcaagcgtaggttctgagcttgatgtcatggcaccaggcgtctctatccaaagcacgcttcctggaaacaaatacggagcgtacaatggtacgtcaatggcatctccgcacgttgccggagcggctgctttgattctttctaagcacccgaactggacaaacactcaagtccgcagcagtttagaaaacaccactacaaaacttggtgatgctttctactatggaaaagggctgatcaacgtacaggcggcagctcagtaaaacataaaaaaccggcgtcggccatggccccgccggtttttttattatttttcttcctccgcatgttcaatccgctccatgatcgacgggtggctccctctgaaaattttgacgagaaacggcgggttgacccggctcagtcccgtatcggccaagtcctgaaacgtctcaatcgccgcttcccggtttccggtcagctcgatgccgtaacggtcggcggcgttttcctgataccgggagacggcgttcgtaatcggatcagaagcaaaactgagaacggatatgagcagcaataacagcgggagggcggccagatcttcaggcccctttatatgaagcattcggccgaagaatttggacagccgcttataaagcttgtcaatgatataaaacccggctaatgacagcagcagatacccggccagtccgatgtacacgtgcttcatcacatagtgccccatctcatgccccataatgaacaaaatttcccgatccttcagtttgttaagcgtcgtatcccacaaaacgatccgcttattcgaaccgatgcccgtcacatacgcattcagcgcattcgttttctccgacatatttacttcatacacatggctggccggaatgtcggccttgtcggcaagcgacaaaattttgctttccagctccttgtctttcagcggatagaaatcattgtataaaggatcaatcacgaccggctgcaggaaaaacaaaaacagggtaaacggcacagtaagacaccaagcgtaaaaccaccatttttttgtatgctttgtgatcagccagtaaaacacaagcacacacacggcaaacagcggaaaactgatccagaaatcaatgacatggtctcttatccagcttgctgctgtctgcgtcgaaatatgatacgcaagcgaaacccgatatccgatccactcaagcggaagcgaagccgccgtaacgatgagtgaaatcacaaatacgaagcttacgatttgcagcacccgaaagcgcaccgctgcttccagccaatgctttattttttttgcaagccccgtaatgagcagcagaaaaaataaaaaccaatctaacggcgctccgatgaaaaataaaaaatcctttacatttgaaaagttttcagcggctgccaggcggcccgggtccatgaacgaggacggatcggctttcgttccctttacggcctccgggacggcggagtctcctgtcataaagaaataccaatagaaaaaaaggccgtacagcacataggcaagtcccgctgccgctatccatttgcgcatggaagtctccctccttagccttatgacttactcctattgtaagcataaatgcaaataaatagaaccaagcctccgaaacggatgttaatcttttcacaacagaaaagaatggaacaacaggaagcgggaaagactaaaagacggagtgatgaatatgaaaaaaataatcgcgtttattgtagtaatcgcccttttggttattgctttcttctatgtatacagccggaccggcgatgtgtttccatcaagcaacgcagatctgattattctgtcagagaacggaaaaaaagaaatcaaaattaaagacaggcagaatgtaaaagatatgctcgatatcttgaaccaaggaaaacaagtcaaactgaccaaaagcgtgtctcccgattacgacggaacggtcaaataccatgaagaccgttttgattcattcagtatgtggctcgaaagcggcaattatatgatgtacaagcataaaaacacgtattacaaactgacccggcatgatacgaagcttgtgcaaagcatcattaaggaagaatcgcacagctgaccggatcagcatgtaaaagcgaagcccccggcttcgcttttcgtccgtcatttcggaagcatgtcccggaccgcccttctcagcagcttcccggtcgcgttcttcggaatctcatcaagaaaaaccacttccgccggccgcttatattttgccaaatgtgtttcacagtaatcgaaaaccgcctgctctgtcagctcaccgtccgcaggcactatataagcatgcaccgcttcccccgttttggcgtcaggaacgccgatgaccacggcttctttaatgccctcatggctgtagagcacttcttctacttcgcgcggatagacattgtatccgccgacgagaatcatatctttttttctgtcgacgatataaaaataaccgtcttcgtcgcgcttcgccaaatcacccgtgtacagccagccgtctttcagcgcgtgctccgtctcctcgggcatcttgtaatagcctttcatcacattcggccctttcacgatcaattctcccacttgatggtcgggcaattcgcgtccgagcgtatcgacgactttattttcgacatgtaaaatattcgtcccgatcgagccgggctttctcccccggtcaaacggattaaaacaagtaaccggagacgcttcagaaagtccgtatccctccagaatggtgacgtcaaaggtttgttcaaacgtctgcaacagagcgaccggcatggaggcccgcctgaaatgcacagtctgacggacgcaaaatcctccgccttgccgtgctcgtattgatacagatagttatacatcgtcggaacgccggcaaaaatggttgcctgacggcttttaatcagtttaaacacagaagccgggctgaattgcggctcgattaagacacacgctccgctcatcagaggcgcattcatacaaacggttaaacaaaaaacgtgaaacatcggcaatgccgccacaattttgtctttctcattcattcctaagtatccggcgacatcatttgcattggagaaaagattctgatgggtgagcatggcgcctttcggttttccggtcgtccctgaggtgtataaaatgacggcagtatcgtctttggacaatgtcggataagttctgctgcgctccgccgggcggagcatttttgtaaacgttgtcatttttaagcgcaattgagggtcttctgtcgatggagcgttctctgctgtctggctgataatgatatgctccagcagcggcagcgagccgtgcaggctttcaaatacgggaattaataggtcgatgccggcgatcgctttgacatcgccgtttttcagcatgtatgcgatttctgaaggtgtgtatgccggattaacaggtatgacgacaattcccgcttttaacgcgccgaaaaacgcaataacaaaatcaggcgtatttccgagcagcagcgcgagatgatccccttttttcagtcccctgtcctccaagccgtttgcaaatgctttgattttacctgccagctcctcatacgtcatgtactgatcttgaaacagacaagctggtttttccggtttctgcgatgccgtttcttccaatttggaaaccagattcattttcccaccctttaaaaatataatgaatgaatagtcattcatttatccggaataaacgttcacttttattatagaaaaatatagaaaaacactcaagggcaaaaagccccgagtgccgtaaaaccggaaactataattgtttcagcgcttcactgaccggcgtgccgcccgctgtcagatcgaacgctttttcatacgtattcggttcatcaagggatgcgataacggtcttggcgacatcgtctcttgaaatggagcctctttctaaatcggctgcggctttgatatttcccgtgccgggatcatttaataacccgcccggccggataatcgtatacgtcagaccgctcgcttcaagaattttatccgcataatgctttgcggcataatacggcttcagcgcttcattccaattgtcgcggttatgagcctgaagggcgcttaccataatgaaccgcttgatgccggccttctttgccgcttctatcgctttcgccgctccgtcaagatcaatcagaagcgtcttatcgtatccggtgcttcctcctgatccggcggtaaacacaatcgcgtcacagccttcagcggctttcgcgatgtcttccgtgcttccttccaaatctgcaagaacggcttctgttcccgcggcttgaagcgcttctttctgctcttctttccggaccatcgcccgcagcgtatgcgtgccgtctttttgaaacagcccggtcagacgctgtccgatctgcccgtttgctccgatgagaaatactttcatcatgatccctccccattcattatggttctatcatttcacaaaaacgggcgcagattcaaatcatgcgttcggcaaatgttctaataaatcagctcgaggaaatcttccagctctattttgccgaaatactgtttcagatcgattccggccagcgcctccctgatagcggttctgtcatactgttttccggtcagcgcctgttcgacttcactcacatctttcgcaccgaagaaatcaccgaaaattttgcagtcctgaatgattccttttttcacttcaagacgcagatcaatcgatccgaccggataacgtttcgaatgctgaaggttgaatgcgggcgaccttccgaaattccagtcccagttttgatagcgctcttcggaaatcttccggatcgctttccagtcttcatcggtcagtttatattccggcacttcggaaagatcatttgtattaaaaatatggtgaagcagatgttttttgaattcgtccgccgtcattttgtcatcaagaaactcgctgatgttggcgacacggcttctgattgacttaatgccttttgattcaattttgtcttttttcacttttaaggctgacacgacatgatcaatggcggaatccagcattaatgttccgtggctgaaaatacgccctttcgtcgaaaattgagcgttgccggaaatttttctgccgtccgcgacgatgtcgtttcggccgcttaattcagcttccacaccgagctggcgcagcgcctgaataacgggttcggtgaattttttaaaattgtggaagctgtcgccgtcatccttggtgataaaactgaaattcagattcccgaggtcatggtaaaccgcgccgcctcctgacagcctgcggacgacgatgattccgttatcttctacgtatttcgtattgatttcttctattgtgttttggttcttcccgatgataatcgacggctgattgacataaaacagcaggtatgtctgttcagggtcgagatgcttcacgcaatattcctcgattgcgaggttgatcctcgggtcggttatgttttggttgtcgataaataacatggtgctcctcctttatttctcccacttcaatccggaagcggcgattgtcacttcgcccccgaacacggattccgcttcttctttcagcttccggtgctcgccgaaatgaggcagatgtgtgagaatcagctcccccgctccggcctcctccgcgatacgtccggcttccaaactgttcatatggccggctgacgtgccgtcctggtccgcgtaaaaattgcactcgcagatcagcagatcggcattttccgcaaacgggataaacgcgtcctggtagcttgaatcagccgtatacacaacagaagctgaaccgtcagtaatccgcatcgcataacaagtgaccggatgcaccgttttcaggaaggtaatggtgaacggcccggcagaaagcgggcggtccggctgataggccactcctttcgtatgcgttttatatgtaagacgctcaaactgttctatatcagcatcatgcccgtaaatcggcagtgcatgcgtcccttttccgagaaaggagccgacctgtttggcaaattgaagcggcccgatatcagcgatgtgatcatggtgataatgggacaaaatgacggcatcaagctcttctgccggaacataggcaaacagctttgataatacggcgcttccgcaatcgacgagcagagaatagccgccggactgaaacagatagcctgaagttgcttcgtttgcggccggaaacccgccgcagcatccaataactgtaactttcatatgaccctccgaatgtttatgataaaaagatcctttcctccaatatacctatttttcgtacaaattgcatgttttaaacattgtgccaaaacagccgttgattttccaaaactgttataatacaatgtagagacaaaacaatgaaagagggatgggtatgttggaaaagatgtcggattttttcagaaatttacccggtaagaaatgcgaagaatgcggaaatgagattgttgagcagtatgagtgtcacattaatctgtgcaatgactgcttgaaaattaaggatatgtgacaatagggcgccgcacaattctaagttgtgcggcgcccgttttttcggccgtcatcatactttctgaatagggcgttattcaccattattagcaattatctgtacgttttaaaagattcagtattttcaatctatatttttctatagacggattgttttcttttctattataatttgttctaatagctatctttttagatacttattgcacttttttcttcgggaggtaatctatgaaaaaattacgctttggactagcgacgcaaattttcgtcggactcatactaggggttgtagtcggtgtcatctggtacggcaatcccgccattccaacatatttacagcctatcggcgatttgtttttacgcttaatcaaaatgatagtgattccaattgtcgtctccagcttaatcatcggcgttgccggcgcgggaagcggaaaacaagtcggaaaattaggcttcaaaacgattttgtattttgagatcattaccacttttgccattattctcgggctggctttggcgaatctgtttcatccgggaacaggcgttaatatacatgaagctcaaaagacagatatcagtcaatatgttgaaacagaaaaagaacaaaataacaaatctatcgcagacacattcctgcatatcgtaccgacaaacttcttccaatcattagccgaaggagatctgcttgccatcatctgctttaccgtgctgtttgcactcggcatctcggcaatcggtgaaaaaggaaagcctgtcttggccttctttgaaggtgtttctcatgcgatgttccatgttgtgaacctcgtcatgaaagttgcgccgtttggtgtttttgcgttgattggtgttaccgtttccaaatttgggctcagttccctgctttcactcggtaaactggtcggtttagtgtatgtagctttggctttctttctcattgttgtattcggaatcgtcggaaagcttgccggagtaaacattttcaaattcctcgcctatatgaaggatgaaattttattagcgttcagtacgtcaagctccgaaaccgtactcccccgcgttatggaaaaaatggagaagatcggctgtccgaaaggtattgtttcctttgttgtgccgatcggatatacctttaacttagacggatctgtgctgtaccaatctatcgccgctttattcctcgctcaggtataccacattgacttgtccatttggcagcagattacccttgtgcttgtcttgatggtcacttccaaaggaatggctgccgtgcccgggacttctttcgtcgtcctgcttgcgacattaggcgcattcaacattcctgcagaaggccttgcattcatcgccggtgttgaccggattatggacatggcccgcacggtcgtcaatctgaccggaaacgcgctggcatccgttgtgatgtcaaaatgggaaggccagtatgatcccgttaaaggcgcgaaggtcatgagcctcgccaaaacagaacaaaacacaaccatttcaggttaaaatgaaaaccctgcacggaatgatttccgcgcagggttttttatgccatcggcgatagaacgtaccggtgcaaaagcttcgccgtattaagaagcgataattcatgcgtgcgttcaaaagcgtgtgaagcgtcaattcccgggccgatcagcccgtgaacgatgtcatggcccgaacggatggctgctgaggcatcagaaccgtaatacggataaatatcaagctgataatcaatgccatagcgctccgcaagcccggccagatgttttctgagctgataatggtacggtccgctcgcatccttcacgcaaatggagacggtatattcatccgtagactggccgtcgccgatcgctcccatatcaacagccaagtattcgacggtctcaggaggaatgttggaattgccgccgtagccgatttcttcattattagaaatcagaaaatgcgtcgtatacggaagttcgattttctcttccgtgatgcggcggattaaattcaagagcagagccacgctcgctttgtcatcaagatgccgggacttaataaagccgctcggcgtaatctgcacgcgcgggtcaaatgagatgaaatcgccgaccctgatgccgagatcggacgtctcttccttcgtccggacaggctcatcaaggcggacttccatattctcctgattccgctctgccttgccggcgtccttgtagacgtgcactgaagtctgatgcattaagatggtgcctgtataggttttgccggaagaagtttggatctcgcaatattccccttcaatcgagtgatatcggaagccgccgatcaagtcaatcttcagccggccgtccgactttatttcctttaccatcgcgccgagcgtatcgacatgcgccgtcagcaatctgtgtttcttgtcatcacggccgggaattgtgacaaaaagaccgcctttgcggtttctgtaagaggagacgccccattcttttaaaagactttctgtataggcgacaacctcgtatgtattgcccgtcggactcggaatcgacaccagttctttaatcagttccatcgtatgtttcatattttccacaggtcattcctcctatcaattttattcttcttaaaatatactcttttgatccataacccgtccaatcttttcctgctcttttttcatagaatgaagggagcatgagcataggagggaaatgtatgatcagccgtaaaccgcacaagcggaaaaggtttcataatgattggtttgaggattggtttgaggatgattggtctggtgcagccttctggtgctgtaaaaaagaaaaagatcactgtaaaaagaaaaaagaagacccttgtaaaaagaagaaagacaaaaagaagaaagacaaaaagaagcatcatcattcatgccgccgctgctgccgtcattggtaatcgttcacacaagcccgttttacaaataaaattctcatgctccccaaacagcggatgctgcttgggtttttttattaaaattagtaccaagtaataatatcaggtgttataatctgatataaaggagtgattttttcatgtcaaaatctaaaattacagcaatcggtacatatgctccggcacgccgattaacaaacgcggatttagagcgcatcgtcgatacatctgatgaatggatcgtccagcgcaccggtatgaaggaaagacgcattgccggcgaacatgaattcacatcggatttgtgtgtggaagcggtgaaaaaccttgcagaacgatacagcggaactcttgatgatgtcgatatgattcttgtcgccacaacgacggcggactatgcgtttccaagcaccgcggcacgcgtgcaggcttacttcggctggccgcacacgggagcgcttgatattaacgccacatgcgccggactcacttacggccttcagctcgcagacgcattaattaccgccggttcccatcaaaaagtgattgtcattgccggtgaaacattatcaaaggtaacggattatactgaccggacgacctgcgttcttttcggagatgctgcaggcgccctattggtggaacgcgacgaatcagcgccgggctttttggcagccgtgcaaggaacagcgggaggaagcgcggacgtgctgtatcgcacgggactgagcgcagaattaaacggcgagccgcttaaaggcggaggaaatatggtgcaaaacgggcgcgaagtatataaatgggcggccagaaccgtgcctgaggaatgcaatgcccttttagaaaaagccggcttttcaaaagacgatctggattggttcgttcctcacagcgccaacatgcggatgatcgaatccatctgtgaaaaactgcccttcccgcttgaacggacattgacaagcgttgaatattacggcaacacttcatcggtttctattattctcgctttggatgaagctgtgaaagcaaaaaaactgtcggaaggccagacgctggtattgttcggattcggcggcggattgacgtataccggacttttggtgagatggggattttaatcgaaatcaaaaaaaagaggccctgagcatctgctcagcgcctctttttcttatgctgttatttcttcttccgttttgtgttcttttttgctttgcaccgtaaaatacacgatggtcagcgcgatcatgacaacggcgatgcccaacagaatggatgcctgctgccacatatagccgtaatcgccatttgaaatgacggcacggaacccgttgatgctgtaagtcatcggcagtgccccgtgaatcacttgatagaatcccggcaggagttcaagcgggaaggttcctccgcttgccccaagctggagcaccagaatgatgacagcgataaagcgtcccggatttcccatcgttgtcgccaataattgaatcatcgacaggaacgcgatgctggtaatcatcgtaaagagatagaatctccaagtgctttccacatcaagcccgattccttttaacagaaccgtggcgactataacggattgaatcagtccgacgagcagaatgacgctgaatttgctgaggaaccattcaaaaccgtttctcggacgccctgaagcttcactcagagggaatacgaccgtcagcatcaatccgccgacatacaagcccatagagagaatataaggcgtcagtccggtaccgtagttaggcacggaatgaatcgcgttatcgtccgtttttaccggatcggcaaacatgctgtacgttttgtcatctgtcttaatgtccccggtttgatcagccgcatctttcagctggctggacaattgtccggtgccgtctaaaagcttgcttaaaccggtgccgagagacgcttgaccctgctcaattttggacgagccgtcatggattttgttttgcgcgtccagcagtttcgttaagccgccagacacctggccgctccctgacactaacgcttctgatcctgatttgagctgtccgaacttgctgttgtattcgccgataccggccgtcaatttgttttggctttcaaagacggtctgcgctccgctgtacaatttatcagttccagccgtcagctggttaatcgcgtcttgtaccgccgccgcgccgttatacagtttcgatgtggactgaggcagtgctttcagctgatcagccttcgcttttacatctgccagcgcgctttttatgactgacatatccggaagctggatatctccgccggacggaagctggctgacgatattgtctaaatccggaaggtcggccttcggaagcttctcattcagaagctgaacaagtttcgctttttgctcatccgttaagaaatcactgtccttaatcacctttttgaccgcgtcatcccgggcatccaggctgtttttcagatcagaaagctttttcttaaactgctgcaattccttttcagtctgctcaagctccccaaccgctttttcaatatctgagaggttgactgaattgatcgcatcttcaaatgccgccgctttttgcgacacttcctgcgccttgctgtttaacgcgcttaatccattcgttaaatccggaagcttttgctggagctgcttttgtgcgtcaaggctcgttttcagcccgctggccacttggcctcctcctgaagcaatctgccctgatttatcttgaatttcggcgcttgcgctctgaagttttgcgatagagctgtcaagcgtttgaattccgcttgtcactttcgccgctccgtctgcaagctgctgcgttttatcgccgatggtggcggtgctttcagtaagcttcgctaaattttccttcagcttggcgctgccgtctttcgcgtttttcgtgccgtcgtctattttcttggcgccgctgctggctttgccgagtcctttggcaatatctttaaaattgtcaaaaatgacttttgcgtattgctccgtcacttctttcgacacggaggctttcagcttgtcgatcgccttttcgccgattgtcgcgccgacatagtttgatccggcattcgtatgatatttcagatccagcttcttcggatttttatccattaccgtgctggcgtttttagaaaaatcttcaggaatctcgaccaataaataatatttagcatttaataagtcctttaacgattgatcaagatcgtttgaaaaatgccaatcaaaattatcatttttctttaactctttcacaagatcgtcaccgatctgaagatgtttcccttcgtagtccgcccctttatcctggttgacaacgacaaccggcagctgatccaccgtgccgtacgggtcccagtacgccttcaaaaacactccgctgtagatcagcggaacgaataatatggcaatgatggggattaacagtttcttgttcgttacaatgtctttccactggctttttattgtattcaaccctgttgcctccttccgcaaactgactcatttgacaaaacggtcacggcacctaaaaagtgaaggatcatctattatttagataatccttgaccaacatacatttccagcaattcggcgatcgtctctttttcaagaggcggatggtttttttcccagtcaaatatcagcgcgatgtagagcttgagcatcacaaaagcggtcagttccggatcacacggtttaatgcttccgttttcaatggctgtttctatcttttctttaatgtatgacagaatggcccgctccattttcgcaatgacatcctgaacggctattgtaccaatctcggcgttctcctgaaaaattttaatagtcagctggtgtgtttttctgaattccaaaatcgcgacaagcgcccggtgaacattttcgtgaaatgaaagctccggtttcatcgcttcgtctgcgtgttccttcatttctcttaaaatagtggtgaaaatatcatcaaacagttcttctttgtttttgaaaaacgtgtagatggttcccttccccacatttgcaagctttgccaccagatccattgtcgttgctttgtagccgaattgtgtaaaagacttcgttgccgcttccagaatgagctttttccgatcgacggacatgtttcccacctcgttaaattgaccgtttgaacgttttagtcattttgtacataagataacttatcacagtcgcaaagaagattcaaatgttttttctctttattggtgttccctttacagaacgggaacatgcaaaaaacctccgttttacgataacggaggctggtacgtttcaaataaataagcgagtgaatcatatacggcggcttttccctggtcgatacagtcggggatgcccaccccttcgaaagacgcgcccgtcgcgtatacgcccggataggaagctttcagcgcatctctgaactctttgatgcgctccttatggccgacatggtattgcggcatgctttcgttccagcgggtcacacaggtcatttccggttcgccatttattttcattacttttttcaaatcttccattacgattttaatgatctcgttatctgaaagatctacgatggattcatctccggcctttccgacgtacgccctgagaagtgttttgccctccggcgccgcgtgcggccattttttattcgtccatgtgcaggccgtgatggagaaatcgctgtttcttgagataacgaatcccgtaccttcatgctccattttgacggctccctcaggaaaacctaaggcgacgttggcaacggacgtagaatgcatatctttgagacatgaaaccgccggcagatcagaaagcattttcgccgcggctttatgcggggctgtcactatgcatccttccgcatagagcactttgccattatcaagcgtcacggaatatcctttctcctcgcggccgatatgggtgactttcgttcctttcatcacctttgtcagcgtaagctgcttttccagctcctccaccaacgtttgaagtcctgtcgtcaccgttaaaaactggccctgctttttggccgtcagctgctgtcccgaaggctgcggacgtgattttttcataccgagaatcaggcttctgtgcttttgctcagtctgatagaattgcggaaacgtggacatgaggctcagcttatcaatatctccggcataaatccctgataatagcggttctattaaattctcaacgacttcgtcaccgacgcgtctgcggaaaaattcacccagagactgatcttccttcggtttgctcgcaggcaggacaaagtcaagcgccgcccgcgcttttccgggtacagaaaataaaccggtggagatgaacggagcgattttggtcggaatgcccatcaccgcgcccttcggcatcggatgaagcgtctcattgacgagcacgtaagactggccggtcgcattgttgacgagcagatgctcaagccccaaatccttaacgagctgcggcgcgctttttttcctttctaaaaaagaatccggcccccgctcaatgatgtagccgtctttatgcgccgtctgaattttgccgcccgctctcgggcccgcttcgatcagggtgacctcaagcggcagctgtttttccttgatttctttttccatgtagaaggcggcggctagtcccgttatgccgccgccgatgatgaccagatgttttttatcgccactcatttttatcgccttctttaccgtttaattctacttgtccagctctttcagcacgaccgctgcaagcgcgtcgataaattcaggctgtgcgttcggcatggccggacgatagtagcttgcgccgacttcttcggtcacagctttgcattcataatcattatcgtaaagcacctctaaatgatcggcaacgaagcctgcgggcacgtatacaaatgctttataaggatgcttttgatacagctcgcgcgtgagatcctgcacatccggcccgagccacggatcaggggtgttcccttcgctttgccagccgactgcgtaatcggtaattccggcgccttcggcaatcagttttgcggattcctccagctggtcaggatacggatcgccgtattctttaattttttcaggaaggctgtgcgctgagacgatcagcatcgcgtcatcccgttcttctttcggcattgattcatacgttttcttcacctggccgacccaataatcaacgaatttcggttcatcataccagctttcaacagacttgatggtcaagccgccgagcttctccgcttcttctttcgcgcgtttgttgtatgactggacgctgaatgttgaaaaatgaggggcgagcacaaggctgacagcttctgtaaggccgtctttatgcatgtccgccaccgcgtcttcaataaacggttcaatatgttttaatccgatgtacactttgaatgttacgtcgtcctggatttcatttaaacgctgtgcgagcttctccgcctgctcctgcgtgatttttgccagcggagaaatgcctccgatcgcttcatatctgtcttttaagtcttgaagcatgtgcggctccggctttcttccgcgtctgatatgtgtataataacgttctatgtcttcttctttgtaaggcgttccgtaagccatgacgagaagtcccattttctttttgctgctcattttgttaaacacctcttttgatggtctgtctaccttgattttgacaggaaaatcttcttataaccaacgatctgctcaggaagattgttccgtttttttggccgcggaatattcatgtacaaacgccgtcagctttttcagcgttgccggattgacatcagggaatacgccgtgccctaaattgaaaataaacccgtccgttttcatgccttgatcaagtatcgctttcgcttttttctcgatgacttcccaaggcgcaagaagaagcgacggatcaagattgccctgaaccgtttttgtaatgccttgttttctggcgtcatctatgccgagtctccaatcaagaccgacgacatcaagaggaaggtcatgccaatccccggccaggtggcttgcgcctacgccgaacatgatcagcggaacttgctctgctgaaagctcccggaatattctgtccatcaccggttttataaactgccggtaatcttcgcggttcagcgcgccgacccatgaatcaaaaatctgaatggcttttgcgccggcattaatctgcgcttttacataaacgataatcatgtccgcgagcttgtccatcagcatttgccacgcttgcggcatactgtgcataaacgcttttgttttgttgtaatttttagaaggcccgccttcaatcatataactggccagcgtaaaaggcgctcccgaaaaaccgatgagcggaacattcagctgttcgtttacgagtaatcggatcgtttccagcacgtaaggaacatcctgttcgggattcagttcgccgagcttttcaatatccgcagcagagcgcaccggctgatcgatcaccgggccgattccgttttttatttcaacatccactccgatataaggaagaggcgtcataatatctttatataaaatggcagcgtccactccgtactgctcgaccgggagcctcgtcacatacgcgcacagctcgggctgatgcgtaatttcgactaagccgtacttttctttcagcttgcggtattccggctgagacctccccgcctgtctcatgtaccagacagggacgtgatttgttttttctccccgtgccgcttttaaaaacgtatcattaaacgcttctcgtttactcatctgaatttccacctttcctcctgcaaccatacgttcgtgttcttcgcccattacactataccttgttttttctgaatggtatagaattgaggcttaatgttcaaaaaatcgccgaattcatgattaagaagaaaaaagcttcggctgaacgtattccgttccctctccttcttgattcgtctgcgaattaaatggaacgactttgtatgaagcccctgaaaacagattggcgtacggtatgtcaaagctgccttttcctttcaccgaatccagaagcttgtcttttccgtctttcttctcatatattcggtaaacaacccgatcatccttttgaatatcccattttaattgaaccgtaatcagtcccatcgccttaaatgtataacgggccgacagggattttaccgcctccagctcaatcgggctgcccagttccttcacattttcaggctttttgaatgtccggccgttttcccccgcttttgtgacgatatctttaaagagtctgaccgggtattggctgccgcctttcagataatgggttttatccgttttgtcatagcccatccagacggctcctgtcagtccgggagtgtatcccgcaaaccaggcgtcctttgtcgcgccggggatgccggtaaatgtggtcgtgccggttttccccgccaggtcaccttgatagctgccttgtgaagcggttccttcttttacgacctgctgaagcattctcgtcatattccatgccgtctgtccgctgaagacgcgcgttttgccgtttttaggcccggataacgtttctccgtcttcgtccgtgatgttctctataaaaaatggcttcgtatacattccgtttgccgcaaaggtatgataagctccggcaagctgaagcggagtgacgccttcagacagaccgcccagcgcaatcgcgagtccgttgtcagaaatgttcatgccgtttttctcaagatacgattttcccatatccacgccgatctgcttcaatgtccagacagcgggcgcatttatgctgtaagtgatcgcatcctgcatcgtcacttcccccttgtactgtccgtcataatttttcggttcatacccgtcgtaggacgtcagtttgtcttggagaagcgaatacggtttgaacttgtcttcctgcatggcgggcccgtatacggcaatcggcttaaacgttgagcccggctgccgcttcgccgtaaccctgttgtatccttttgtcacgtagtcgcgcccgccgaccgccgcgcgcacgcctccggttttattatcaataaagacggcgcttccctctgccgcctgatccgtccccggaaaatagccgctttccttcatgagggtatatgccgttttctgcagcttggaatcaagtgacgtccggatcgtataaccgccttgaagcagctgttctcctgacatcgaataacggtcttccgcctccttgatgacaagatcgatataactgtcaaaccaaggcgtttctgatgttttcttgacattaagccccaatgtccggccctgggctctgacggcttccttggcgctgatatagccttgatcgttcatcattgcaagaatcgtatcgcgccgttctttatttttatccggatgctgaatcggcgaataaagagatggcgccttcggaatcgctgccagaacggctccttctgcaacggttaaatcttttacttctttattaaagtagtagtgggacgcggcttgaatgccgtaaacgccatggccgaaataaagctggttcaggtacatttcaagcagcttgtccttgctgtaatcacgctcaagattgatggcgataatgacttccttcgtcttgcgcaaaaatgttttatcatgagtcagaaaaatgtttttcgccagctgctgggtgatcgtgcttccgccctccaccttgccgcctgctaaaacatcccggaacaccgcccgtccgacagacttcacatcaatgccgtgatgttcgtaaaaccgtttatcttcaacggcgataaaggcatctctcacatcttccggaacctgctgaatggataccggctcacgattttccgtatagaggctcgcgatttcatcaccgttttgatcgacgatttttgaagatgcgtgcagtattaatttcttttcatcgatgacataatggccgagaaatataatgataatgtatccgattaacgcgagaaaagcggttgccgccgcaattacagccggaataaagaatctttttttctttttcagcataagtcacctcgcctttcttaacttgtagtatgggaaatattgtttcgaattatgtcagaatgagtcgccaatagaaacttataccactcttttgatatactagcaagcaggaggtggctgatatgaaggtttatattacatacgggacagccgattttttaaagacgattgccaagaaacacccgagtgagaatatggtgctgatgcaaggggaggataatgcggttttaattcatgaaacaaatggagaaaccgtttttcaggcgccccattcctatgaaagcatcgacagcgtcggggaaatcaaaaatccgggctacgccgtcctcaacaacatcgccgttacccaggaaggccgtccgctgtttgaaaaccggtttaaaaaccgcgccggcaaagtggaaaatgaacccggttttaaagccatccgcgtattaagaccgctcgaaggcgatacgtatgtcattttgaccctgtgggaagaggaaaaagcctttcaggattggcagcagtcaaactcttatcaggaagctcataaaaaacgcggaacatctgccggtatcgacacgacgtctattttttcccgtccgtcttatgtaaccgcttattacgcaatagactgaaaaccgccggagattctccggcttttttgatgtcccgattttacgcatccttctttgcaccttccgcccgcctatgaataccctgtagcaatcctatttataaacggagtggttcaattggggatcggcgtctactcggtacatctgctttatgttgcttttatcgcggccattatcgtttttatgcttctcagaaaagatacaacctttatttcactcgccggcatttttgtgattgcgctatggacgacgcattcattctccgcttcggtcagcagcctgtttcacagctttacgtatgccgccggagaattgctgccgacgatttttatcatttgttttatcgtggcgatgagcggccttttgaccaaaaccggtattaatgaagcgatgatttctccgtttgcaaagctgatgaaagggccggctgtcgcgtattgggttatcggctgtctgatgtttgccatctctctttttttctggccgtcacccggggtggcgctgatcggcgctgtgctgcttcccgcagcgatccgggcgggcctttctccgatcgctgcggctatggcgatgaacctgttcggccacggattcgctttatcgggggattacgtcattcaggcggccccgaaattaacggccgatgccgcgggcatcccagtgagcgatgtcatgcaggcaagtattccgctcgttttgatcatggggttaacgacgacaatcaccgctttcttcctcatcatgcgggatcgaaaaaaaacgaaggccccctctccttggacagctccggttctttggacacaagtatgtatctgccgaaaaaactcagggtgatcctggcggttttcattccgcttgtttttctcgccgatattatctgcatgatcgtataccgcctccaaggaaacgatgcgacggcactcgtcggaggaaccgcgatcggcattctcctgatcattcatttcattgtatataaagagcggcatttagaaaagatcaccgagtattttatcggcggttttcaattcggctttaaagtattcggccccgtcattccgatcgcggccttcttttatctcggtgacgcggggtttaaaaatattttgaacaccccgctgccgaaagggtctgcgggaatcgtcaatgacctcggactggccctgtcccattcttttccgatgtccggagaattcgccggcatcgccctggccgcagtcggtgcgattaccgggctcgacgggtcagggttttccggtatatctcttgcaggctcgatggcaaagctgttttctgccgcgcttcatacggacccggccgttttaacggcgctgggccagatttcagcgatctgggtcgggggcggaacattggtcccttgggcactgattcccgctgcggctatttgtaaagttgacccgtttgagcttgccaggaaaaactttatccctgttgcggccggacttatcgtcacgaccatcgccgccatcatcattctcccgtagcaaaaagattgaaatcttctgacattttctatacaatcatgggaaaagcagacgagggggcatcgcttttgacgttaacgacacttcaaaaaagcttaaacgctcagcttgacgggctgtatgaggaaatggttgaaatcaggcgtcaccttcacatgaatcccgagccatcctttaaggagaaaaaaacaccggcgttcatcgcctcattttatgaaaagctcggcgtccccatccggacgaatgtcgggggcaacggtgtcacagcctgtattgaaggcggtgaaccgggaccggtcgtggcactcagagctgattttgacgctttgccgatacaggatgaaaaagatgtgccctatgcttcacaaattcccggcgtcatgcacgcctgcgggcatgacggccatacggcggctctgctcgcggccggaaaagtgctgtaccgcaaccgggaaaaactgaaagggtcatttgtgatgatccaccagcacgctgaggaattatctcccggcggagcaaaagcaatgattgaggacggctgcctcgaacatgtcgatgccattttcggcacacacctatgggcgactgaacccgtcggaacggtcttatgccgcccgggcccagtaatggccgccgctgacggctttacgattaaagtcatcggcaaaggcggtcacggtgcgatccctcacgatacgaaggacgccgttttaatcggctcacaaatcgtcacggctcttcagcatatcgtcagccggcgggtaaatccggtgcagccggccgtcatctcagcaggctcgttcaccgctgaaaatccgtttaatgcgattgccgatcaggcagtcatttcaggcaccgtccgctcgtttgacgaaagtgtgcgcggcctgctcgaagcagaaatagaagccgtcgtaaaaggaatctgttccatgcactccgcttcctatgaatatcgtttcaaacgcggctatcccgccgtcgtcaatcatcctgaggaagcggcgcacgcggcggcagccgcagcggaaacagacggcgttacgaaagtcgttgaaggagagccgcagatggcgggagaggatttttcctattatctgcagcatacaaaaggcgcttttttctttacgggcgccgctttagaaaatgcggaaaccgtttatcctcatcaccacccgaaatttgattttaatgaaaaagcgatgctgacggccgccaaggtgcttatcggcgccgcggtaagctacccccgctgacataaaaaaaacagccggtacattacgtaccggctgttgtaattcttaaatgaaaaacgtgccttgccgtctcaccgagctgtgacagcagtttataattggccgctccgcccacggcggctccgacgaccggcaaaagctgaaacaatttgaccacgtccagataatcgcggtattcctgctgaaaaactctccaatcgacatcatgctttttcgaatcccactgttcaatcattgagtatatgcgtttccgctgttcaccgcttgagaaagccagctgaaaaataaacagcaaaaacaatcgctcatccctgtctttcacatcatagccgtaaatggaggcaagatcgaacagacatttcattttaatggatagcagcaaaggaaaatcagccattcctaaaaaaattccgccggcccccgtaccgataccttcagctgccgcgaccttttggtacgatgcgatggtttgtctggcgagagcatctttttcagcaagcgtcataccgtttgtatcccgcttgcttttcaccagatttgaacccgccattgttgcttcggtcatttttttaatgctttctgtgatgacggcatgaattttttcgggaatccgctcatttattttcgcctgcattcctttagaaaagcgttcaagcatggaatctttgcgcaaaaaacgcgctttccattgcagtgcttcctgtaccagctgctgatcgtcggtcatctgtgtctccttctttcattgaggtttcaaaaacccgattgattacagcttgccgtactttttcaatcttccgcccatatacgatggcatgatcacaaaaatcagaacggctgaagcaacggccgcatacagcaccccgctgactcccgcggcataggctgacgctgcgcagaacagcagcgcctgcacggttaatgacgatttcatcagcgaaaagaaactttgcagcttcgctttctgattgaccgggtaaagctcctgcagagaaagatgatgaaaatgcccgaacagcggaagaagctgtattcccgtaataaagacggtaaatacggttaacgccgccgtgatccacggattggcggaaacgagcataataatcaggataaaaataatcgtgagcctgacctgaatgccgagataatcatttgaacgcagaaaggcccgcgcatacatataggagaacgttttccgctgctcaaacggaatcattctgagcaaaaagtcgagatacgcccggcgttttgcctgttttttcaggtgaggcacatcggtaaacagattggcgattctgtaaaaccgctgcttccttcttaattcatattcaatatgagcttcccattttaatgatttatgttttgcggctgatgtgaaatacacataaaggccggccatcacaatgtagacggcggcagcgtacacataaaacgactgtaagacgaagtataaaagcagcatattgcagataaagcgtatgaccgcatccatcattttcatgcttctgtcattcataaacgtcatccgccactccatggcctgattccacgcttttaccgccagcatctgaataaatacggcggcatacgacgcaagcgacgcccccggacttacagcgaaaaacagaggcatgcatacaagagacagagcaataagcggaaacagctgtgacagatagctgtacttaaatgaatgcttaaagtatgtccccattttcggttcaagcggcagcagaaacacgaggtccgcttcctttaacagcgtccggacgtatgaaccggtcagcacaaatgaaaagagcaccgccatcacccaaaaagagggaaaatgaacggggatgtctttgacccacttgctgtaccagctcgccgcgccggcaataaaaaagatcagcacaatgacgagatgatcattgagcatatatttcatatacattctggtttcctttatatgctcttcaagccgggactgccaaatagtagacatattattcatggccggcgtcttccttcgtcagttcaatatacaagtcatcaagagctgcgtctttcatgccgaactgctctctcagttcttccagtgtgccgcttgcccgcacttcgccgttatgtaaaataatgaatgcgtcacagtagcgctctgccgtagccaggatatgcgttgacatcagcacgcttgatccggcttttttcgcggcgtccatccgctccagcaatgcattgatcgcaagcgggtcaaggccgagaaacggctcgtcaatgatataaagcgagggctccgcgagaaacgcgcacatgatcatgaccttctgcttcatccctttggaaaagtgagcgggaaaccatttcagccttttttccattctgaattctttcaaaagcggaggaagccttttttcaagcgtttctttggaaaggccgtacgccatggccgtcagctccagatgctctttgagcgtcagttcttcatacagcaccggcgtttcggggatgtacgtaaattgcgagcggtagctttccttatcctccgaaaacgtcttgccgttcagctcgatcgagcctttatgcgggtccattaatccgataatatgccggatcgtcgtgcttttgcccgcgccgtttaatccgatgagtccgacaatctggttcggctcaagggtgaatgaaacattttttaagaccgggtttctcgtataaccgccggttaagtcttttaccgatagcagagacataatttctccccttctgattcgtttttcttcatagtaccaaaaataaagtctgatttgaaacgattccctttttttctcacgtgaaaagcgtgcatagttatcgttttggcggacatcataatgtatgtagaaggaaacagctttaatcaactgaaaatgaggtgtttataaaagacgtcttagaacagttggatgaaaatcaacatgtcctgtgcttacaatttcttcacacactgctttgatgatgttcttcattcatgatgaaataatcaaatgaggtgtttgtcccaggaatgattaagcagacccataagtcttcattttaaaaacaaatgaggtgcttacaaaaggcatatttaattttctgtgataaagctcgtacttctgcatcagggtgaacgcgcagccgttcatcctgttttttgttttgaccgtttttgtggtacgatgagaatatacatatatttcttttcagggaggaaacccatctatgcacaaagcggacgattgtattttctgcaaaatcattgccggtgacattccgtcttcaaaagtatacgaaaatgaacatgttgtggcgtttcttgatatcagccaagtcacaaaaggccatacgctcgtgattccgaaaacacatatcgaaaacgtgtacgagtttacgcctgagctttctaaagaatatttcgaagcggtgccgaaagtcgcacgcgccatccgcgatgaattcgagccgatcgggctgaatattctcaataataacggtgaaaaagcgggccaatcggtgttccattttcacatgcatatcattccgcgttacggaaaaggcgacggtttcggggctgtctggaagacccacgccgaagactatacgcctgacgatcttcaggagatcgcttcaaccgtcagaaaacggcttgcctcatcttaaagatgaggtttttttgcgtccggcaacacaaaaaacataaaattatattttttcatatcaaaaaaatcaaaaaattgtgataggataattgtattatttcttacactaaagcggaaaacagggagagatcgtaaacatggaacgtacaacgaatttcaatgcaggacccgcagcccttccactggatgtgctgcaaaaagcacagaaagaatttgtcaacttcaatgacaccggcatgtccgtcatggagctgtcccaccgaagcaaagaatatgatgcggtgcatcaaaaagcaaaaagccttctgaaagaactgatggatattcccgacgattatgatattttatttcttcaaggcggcgcaagccttcaattctccatgctgccgatgaactttttaacgccggagcaaacggctcacttcatcgtaacgggcgcatggtctgaaaaagcactcgccgaggcgaaactgttcggaaacacatccgtcacggcaacaagcgcagattcaaaccacaaccatataccggaagcggacctcacaggaatcaaagacggcgcctacctgcatcttacgtccaataacacgattttcggaacgcagtggaaagagttcccgaattcaccaatcccgctcgtagccgacatgtcaagcgacatcctgagcagaaaaattgatgtcaaaacgtttgatgtcatctatggcggcgcccagaaaaacctcggtccgtccggcgtcacggtcgtcatcatgaaaaaatcatggcttgaaaacgaaaacgccaacgtccctaaaattttgaaatactccactcatacaaaagccgattcactgtataatacgccgcctacatttgcgatttatatgctgagcctcgtccttgaatggctggctgaaaacggaggtgtcgaagcggctgaacggcgcaatcatgaaaaggccgacgtcctgtacggcacaatcgacgcaagcggcggtttttacgcggggcatgccgcaaaagacagccgttctcacatgaacgtcacgttcaccctccgcgacagcagtctcacgaaaaaattcgttgaagaagcgaaagcggctaaaatgaccggactcggaggccaccgctcagtcggaggatgcagggcgtctatctacaacgccgtcagcctggctgattgtgaaaaactggctcagtttatgaaaaagttccagcaggaaaacgaataaatttcttctaacataacggttcctttgatatactgtttgcatatcaatttttccggccatcgcaataaatgacgagcatattattggatggcgaaaaagcttagcagaggagagcttagtatgaaaacaaaagaattagtcattatggccctgtttgcggcaatcggagcggtgcttcattccattatgccgccggtattattcggaatgaaacccgatatgatgcttgtgatgatgtttatgggtattctgttatttccccgtgtgcagaacgtgctgatgatcgggattgtaacgggaatcatttccgcactcacgacatcttttccgggcggacagcttccgaatatcattgaaaaaccggtaacggcgtttctgtttctcgcgctggcgcttttggtgaaaaagagcgtgaaaacagcggccgccgccgtcattacaatagccggcaccttcatctccggtttgctctttctggcgctggcccttctgattgtcggcctgccgggggattcaccgccttggtgctcgcggtcgtccttccggcggctgcgctgaatgcgatcgccattatcattatgcatccgattgtgcagacgatcttaaaacggtccaatatgattgaaacggtgaaataaccgcataccgaaacctcttccggccggaagaggttttttaatgtgtttcagcatgttttatacgagaagttttgtgaaaaagataaggaacaatgcgagggcggttcctgctgagcagacgatggccttttggcggacgacccgcttcggcggataagaagcggcctggccgagcagtttcaggtaataaacggcgcccgccgcaaagacaagagccatacaagataaaacaatcataaagacagacaaccttctccctccttttcccttaaaaaatatgctaaaataaagcaagctatgtatagaagtttattcttctgaacaaaaatgataaaagttatgagaaaaaaaacggggtgattttaaatggctgacggacgttcccttttaacaggccttttcgtaggcggattgatcggaggcgcagcggtgttactttcggctccttcatccggaaaagagctgcggggcaaaatcaaagcgaattgcaattcaattgaggacacaatcaaacggttaaaaaaagacggaatggcgcttaaagaccagcttgtccaaacggcgaaagaaagcgcagaagtcattaaagacgtaggcggagagcttcagaccagcattaaaaggtggcaggaggaaatcaagccgcaccagcaggatcttcaaaaggaaatcgctgatattgaagagaaaatcagacagctggagaaaaccttacaaaactaatatcctatacaaccaaaaaaagtgcgggcatattgcgttccgcacttttttttgcggtttaaagcctttcacagcaacggattaagaatttattataaaattcttaaattttcatctttattaatctttattttattggcataatagaggaaaagaaaatgtgaagcaggtgatctgtattgaatcgtgttgaaccgccttacgatctaaaagaagctttaatctatacccaaaaaatggcgcagctgtccaaagcactctggaaatctatcgagaaagactggcagaattggctgaagccgtacgaccttaatattaatgagcatcatatattatggattgcctatcagcttaaaggagcttctatttcagaaatcgccaaattcggcgttatgcacgtatcaactgcatttaacttttcaaaaaagcttgaagaacggggatatctgaaattttccaagcggctgaatgataaacggaacacgtacattcagttaacagaagaaggggaaaatgtattcgaaagcctgcttgaggagtttgacccgtctagaaacgcggtgtttaaaggctcacagccgatctaccacttattcgggaagtttccggaagttgaagaattaacctgtgtcatccgccacatttacggcgaagattttatggagatattcgagaaatcattgacaaacataaacaatgattttgatagtgaagacggaaggctgaagaaaaaaacagacgaatcggctgtccatgaaacggctgaagagctggaaccgatcaacagttaatcaaagtgcttcattatctcaataaattcttccatcagcgctgtataaagcccctgctcatacagagcaaaaatcgtttcatgaacatctaatttttcgttcagctgtcccgcaaaaagcgcaaggagcttgtcaaacgtcacaaagccttgcgctttttgcgactccagctcgtcctccaattcgcggcagatccgcccgacctcttctccttcttcttcggtcagccctttttcaatcatcatcgcataaaaagggtacttatccatatccaccgttttcaccagcaattgtatgtaatattctaaacgcccgatacgctgatccattgaatccatccgtttcacttctttctatctttaatcttattttagctgataatgaatggagaagaaaggttaaaccgtacatttccatgtttcaccgagctcttctgttcttccctttccggggttattttttttctttaaaaaaggattgattttttctcctgaagagagtaaattattttgagattgtattccatctttgtacggaaggatgactctgatgaattgctggaaaaccattaatctgatcaaagattatggtgcggttcgtttattattgactgctgtaggttttatgatcctgttttttatatgcaacttcttggcattcgggctgctgcgtccgaatatcagtttaagtgacgggcacgtgtttgctttttgtgttctgctcgttgttactttatttgtacataaagtcatacatgtcctgccgatgatctgtaaaaaaagaaaaaaggaaatgaaaatgtacttcttgcggatgccgacatggaaaggcataccgaaaacgacgatgctgatttctacgatcagcccgtttttattcattacgccgctattgttttatgccggactggcatttccgagacacgctcattacttttatatgatttcgagcattcatgcgggttattgcctgcctgatcttctgtttgcgctgcacctggtcaaagcgcccaaatcatgtctgattgaccaggaatccgacggttttgatattttagtaaaaaaagtgccggagtcttgatatcccgctgatttttcaggttacattctatcttttttaataaatatttggtaatgtaatatgggagcagttcagagagagggggaatctcccatcattttattctattttatcgtggctgccctgtttattctttattttataaacaggctcacaaatacattatgccttgtcagagagattcctgaagaccggcaggataaggtattccgttttattaatgtatctattttaattttactgatctcttcattcgtcgagatctcctttactgtgtaaacaggcaaaaaaatatggctgacggaggtctgacccccgacagccatatttttttcttaataaagccaagaagcgccgatgatgatcaataagatgaacagaacaaccaataatgcaaaaccgcctgcaaatacttcacccatctccaaaagcacctcctacaaaacgttttatttttccaattacatcatatgcaatttacttctgaaacgattaggcgcccgggtaagaaaacggatcgcttttagaaaaagcgatccgtttcgcttaacaaatgtaagctgcacctacgatgataagcaatatgaacagtactacgagcagtgcgaaaccgtttgaatatcctccgcccatggttcattacctccttttcatgatcaatatatttgtatgtatcaggaaaaagtttgactagacgaatgccctttatttaaaatctttttacagaaagccacaatatgttatgatacgcatatgcaatttaatttggatgattaggagtgtttaaaggaatgaagaaaatcgcgatagcagctattacggcaacgagcgtcctggctctcagcgcttgcagcagcggcgacaacgacgtgattgccaagacggatgccggaaatgtaacaaaaggcgaactctacacgaatatgaaaaaaaccgcgggcgcaagtgtgctgacacagctcgtacaagaaaaagtattagcaaaaaaatacaaagtatcggataaagaaatcgataacaagctgaaagagtacaaaacgcagctcggcgatcagtacagcgcccttaaacagcagtacggcgaagattacctgaaagatcaggtgaagtacgaactgcttgcacaaaaagcggcgaaagacaacatcaaagtgactgacgctgatacgaaagaatattacgacggcttaaaaggtaaaatccgggcgagccacattcttgtcgctgacaaaaagacagctgacgaagtggagaaaaaactgaaaaaaggcgagaagtttgaaacgcttgcgaaagaatattcaactgacaactcaaaagacaacggcggcgaccttggctggttcgataaaaagtcaatggatgaaacattcagcaaagctgcattcggtctgaaagtcggacaagtcagcgatccggtcaaaacaaaattcggttatcatatcatcaaaaagacagaggaacgcggcaaatatgatgacatgaaaaaagagttgaaagaagaagttcttaaacagaaattaaacgacaactcagctgtacaggcggcaattcaaaaagtcatgaaaaaagctgacgtaaaagtggaagacaaagacttaaaagacacgtttaacacttcaacttcttctgaatctaaataaaaaaaactgtgcgggctctcagcgagccccgcacagtttttttatgcgatggaatgattggagttttcttctgcatccgtgttttcacttgcgggcgccgccatacggcgctcgcgttcctgttccatccgttcaatatacacccttccttctttttcaataaacgactggtcaagcttttcctcttctttagctgttgtgaaaagcttataggcgctgaaaataattccgataatgcaaaggtatacccaccaaggaaaaaatagcacgtcggtttcctccctttttcacccagagtctttattctaagctatgcttgataaagacaagttatgagagctgaacgtaaaaaagaccgatcatagagaatcggcctttttatcttattgatggaacgtcggtttgtagaaagaacggttttccagcgcaaatacacgctctgtgtattcgcccggcttcacccgttccagcgctctgtccatcatgatcatttttgcatccagattgtcaatgtagtgcagaatttccgcttctttcaccatcggcggtttcgggcttccccattccgcttttccgtgatggcttaaaatcaaatgcttcagaatcagcacttcttcagcgtcaatctgaagctcttcggctgcttttgaaagctctgtcaccatgatcgaaatgtgcccgagcagattcccttccacggtgtacgtcgtggagacggggcctgaaagctcttttactttgccgagatcatgcagaatgactccggcatacagtaaatcccggtcaagagacggatacagatcggcaatcgcttttgccaggttcagcatggacactacatgatacgcgagcccggagacgaactcatggtggtttttagccgccgccgggtaatccataaactcagccgcatattttttgaccagatgtcttgtgatccgctggatatttggatttttcatttcaaaaatgtattgagtgacggtttccatcatttcatttttcggaatcggcgccgtttccagaaaatcatcaatgctgacattttcgttctcgccggccggccggatgtttctcagcttaagctggtttcgtccgcgatagtgatggacatctccgatcaccttcacgatcgtctgcgccgcgtacgttacttcatcagtcggcttggcatcccacagcttcgcttcgatatctcccgattggtcctgcagcattaacgtcaggaatggttttccgttgcttgcgattcccttagtcgaagatttaatcagaaagtattgatcgacctgctcgccgacctcgtgcagcataataccttttgccattctattaaaagctccctccatatcttacataataccagtatagcacatacctcttttttgaaaataaactcttttatgacaggagccgcatgacttgtccgctgtgaaaagaccggctgacatgctcatggcaggtgaaataaagtatctgccgcccgccttctgaaagctgattcagcacatcaaacagccgctccagccgctgcctgtcaaaatggacaaaactgtcatcaagtaaaaacggaagtgataccgcagattccctctctgacgcaagggcaaaacggatcgccgcataaagctgctcgcatgccgcctgtgacagttcgcctgctgaaaacacagttccgtctttccgcatgaccataatggaatcatccgcctcggagaaatacaatttatggtaacgtccgtccgtaagcggtccgtataatgcaccggcggtttctaacagacggggaagcgtcacttttttatgccgctccattttttccctgatgatgtgtctgaccgtctgtaatgcggcccactctttagcggtttttttcacgcgctccttctgcatttctgtctgctgttttaaatcggatacaagccccgaggactccagctgctcttgtttcaccgttaataaagcggttttctcacggagctgcgcgcttttttcctcaagcgtttttttctctgtttccttctgaacgactgtatgttcaagttcggacactgtgcggctcatatacggctcaagctgttttccgcctatgccggacaagtgcgttttgatttcgcgcagctgccgctctgtttcccggcggctttcattcagtctggcgagttcacaaaagtgttcgcgattttttgcgcctgccgccatgaaaagctgtttgacctgctgttcgtagtaatggacttcttcgtttaattcacgcatttgctcttgtgcatgcagcagatccgtttcgagcgcctgctttcgttttgcttcctcacgggcccgttccgcctgtaccagcaaaacgcgcagtctttcttttacggacagctcccttccgtctgaaggactcagctttttgacccggtcctcaaatgctctttgcaacttttgcagccggcccgcttcaatggtcagctcatgcttattaaggatttcttttttgacatctttcatcacatgatatgcgtcaagaagatgggaaggacttcctgaaaaacccagttccttcataaaaagttccgcctgtttttcagacggcgccatttccgcctcccattcttcatattggcggatgactctttcatatgccgcttctttctgttcaagcacggcttgatccgcaatcagctgctgccggtgccggccgtcacgccaaagctcttcctgcagaaggtcagccgcttctttggagatcgtcggcttctttttcttgtgaccggcccctcctctttctgacggcagcggtttttgcatgccggacagcatatacagcagcagagcgccggtaaaaagggcggcgggcagccattcctttaacatagcgaaaatcgcaatgaacagaatgcccgcaccgagaaagagctttttttgtttggcgcgctgtttttccagctgctgtacatgtgcctgccattcgtttccttctgtatcagccgtttgcttatatgattgtaaagcggcttctttttctttcctgacagcggggtccaaaatgttttccgacgtcaaggcatgttttcgttcggcttcttccagctccagccgcgcttgttcgaaaatcgcatcaagctgtgtctttctttctcttgcctgtccggcgctctgcacggcttcctgcagccgccattcatattcataatcggtgttcagtgaaagaatgccgtcttcctcatgtcttccgagctgctgcaatcctgacaaaacgcgggcagatgtctgccggatctgtgattggatggcggcaagctgttcaccgcgcgattcgtacatatgctgctcgccggaaagctcctgcagctgccgctctgtttgcagcaagtcctcatttggagcgagcagctcagcctgccgcctgagttcagcagcttttgcccgaagtccctcaagacgggcagctttcggatggagatgcgattcgtatttttcaagctgatgcatcccgtccttcgggaattgcttcaatgcatccggataagaagaaagttcgctttccaaggctgtttttttgtctgcgagcggctttgcttctatcgccgattttactgttttgatttcttcagttatgtctttcaatcgtgcttcggcatcctgcaaacggccgccggcgctttttttctcttccagaaggctgtgatagcccgcttccgcagcttccgcctgtttcagctgggcgctgagccgctttaatgtatccaactcctgatttaagcgggggttccgcccgttcggcttatacatcctttcaagttcttttgccagccgcccgtcaagctttgccgccgcttccgacccgaataagctcgaatacaggagaaactcgccgattttgtcccggttaaaagcttgaatctcctgcagtccgaatacatcgaacgaatagatcgcttcgtacagcgcccggtctgtatcggagagaagctgtttgagccattctccgtccttgatttcgcctgaagccgtatacactctgactttttcggcagcgccttttgtccgttcgattttgacggcaccgtgatcgccatgcttcaattccacagtgccgccgtaaaccccgccgtttttcggttcgtatttttttgatttcggaaaaccgaacagcacgcttttgatgaaggacatcaatgttgttttacccgcttcatttaatccgtagatcacttgcacgggagaatctgacagctgaaaactttggtcggaaaattttccgtattggtaaatatgcattgccgttattttcatcgctgaagctccttcatctggcgtcttaaaacggcttgagcctgccgcttaatatccagtatctcttcatctgtaaatgaagtgatctgacgccgatatacgggatgacgctcaagggcttcaaatacaccgctcatgtccgcgcattgttctatgtcctgaagcagccctttaaaaaacggatcgggcggcacgctgtctgtttcatccgtccgatcctcaagcgcaagcggccagacgaaacattcctcttcggcctcttcctcctgtaaagcggaaagaaactcctctgcgatgcctgcgggcgcctccgtccaaaagcggggcgccgcgccgcgaagcaccagcctgacacatgccgggcggcccgccgcgcgcaagccggagaatgtatccgatgcggctttcagaagtgaagtcatatgttcagctcctgagatatcaagatcaatttcctcccataacacatcatgcgcttctttgaattcccaagacatctcaccgtttgccgcccggacgagataatatcccttaggcccggtttcttttaaatgccgggcttgaatattcccggggtaaatagcggcgggatgctgggcggacagaacctgccgtttatgaatgtgtccgagcgcccagtaatccatgccgcttttttcaaggtcttctttcgtaaacgggcagtacgggtcatgcccttccgctcctgataacatgccgtggagcatgccgatatgataaggcgcgccggtcattttccggtaacgggccgcctgattgaccgttacgcttctttcctgatagctgcatccgtatatgcttgccgcaagctctccgtttttaaagaaagatttttcctccggtgtacccgaggtgaatatatgtacattttccggccattcaatcggcgtccacttaccgcccaaatgatcatggttgccgaatatgacgaacacttggatacccgcttcctgtaatctcgtaaactgttttctcaaaaacagctgggcttttaaacttctgttggcttcgtcaaacagatcccccgaaagcagcacgaaatctgcctgctcccggagtgccccgtccgtcagacggcggacgctgtgaaatgtgctttctttaatacgcgcatataccggttcaggcagattcgaaatgccgtaaaacgggctgtccagatgcaggtcagcggcatgaataaacgtcagatcagccatctcgccctcccctttctgcagattgaattacccttattttagcaccgtttttatacgaatgcacgttctgtaaaataaaaaaacagcccggctgttccgggctgtttcatttattttttggagatgcgcagcgcttgtttgatcgctttgaatccgctggcgtttccgtaaatcaaaacgccgcctttgtaaattttcgcgccgaccgccgcaaagatcacgatagtgaccagtgtcagggcgatcccggccgcagcctgccaaaacgggatatcgagcatcccgacgcgtaaaaacataatcatcggcgtgaaaaacggaatgtaagatgtaacggtaataaaaccggcgtcaggattgccgatgccgaacatggcgatcataaaacctgccacgaccaaaaaaaccatcggctgaatcgtctgctgtacgtcctctatccggctgacaacactgccgagaaacgcggcaagcgtcgcgtaaagaaaatagccgagcaaatagaaaatgacggcatagactatcgtcgagacgggaacatccgtaaaattgaggaatgcactgatcggcgacgacgcatcattttgagggttcagcttcagtgagagataacccgctgcaatcagcaccgcaaactgtgtgatccccacgagcgcgataccgaacagtttggcaaacatctgctgaatcggcggcatgcttgaaattaaaatttccatgacgcgggacgatttttccgtcgccacttccatcgcaatcatgcttgcgtacatgataactgagaagtagatgacaaacagcatgatgtatacaagccccattacctgaccgagctcttcctcagatttcgcccctttttccagcgcgtctttgctgacttccggcggagtgtagaggctgctgactttttctgccgaaatgccgagcttggcggtttcgacagcggttttcgtctgggttaaagcctgcttgagcagtttatacgctgattcatcagaaatggtcagcgccttgtatgctcccgttatcgttcctttttgatcctgtctgatgataaacagtccgtcccattcaccgtctttgacacgctttacggcatctttttcggactccttcgtctccattgcctgcagatcattgtctgtatccgccgctttaagctgttttgcaaacgccgggtacagcccgcccgtttcatcaatcaccgcgatttgctgcttgccgtcatccgattgaaacacggaaataatcgattgcaggttggtcaccgctaatactaataaaacggtaatggcggtcgaaataatgaatgactttgttgcgattttgtttttatatgtatgaaacagcataatccaaaatttattcatatacggcccccaccttttctataaaaatatcatgcagtgacggctcttccaattcgaacttccgtataaaacctttcccttgcagcgcccggaaaatatcctgcgaaaccggttcattcgcgacctgcagtctgattccgtcatttgtttccttccatttcacgacaccttcatgcgtttttaaaaagctgaggtcatcatctgaatgaacggtgacattttttttgccgaaagaccgcttaatgtctttcagattgccttgaacgacgggttttcccttctggagaatgcacaaattctcgcaaagttcttccacatgctccattcggtggcttgaaaaaacgatggaaacgccgctgtttttcaaagaaataaccgcttctttcagcagctcgacattcaccggatcaagaccgctgaaaggttcatcgagaatcagcagttcaggcttatgcaggacggccgaaatgaactggattttctgctggtttccttttgacagctcttcgactttcttattcttgtaatctgtaatgccgaagcgttcgagccatgtcatgagctctttttccgcctcttttttgctcattccttttaatctcgccagatagacaagctggtcactcaccttcactttcggatacagcccccgttcttccgggagatagccgattttttcactgatggaataattgaccggcttccctttccaggtgatatgcccgtcagtcaggcttaaaagacctaaaatcatccgaaaggtcgtcgtttttcccgcgccgtttgcgccgagcagcccgaacatttccctttcaggtatttgcaggttcaaattgtcaacagcggtaaagctgccgaatgttttcgttacattttcaattgtaagcacgaatccaactccttccttgacccattatatactaataatgggtaaaaattaatggaggattttaaattctttatcagaatatcattctataaagggggtgacatgatgggacaatatgtattgaccgcattccatgcgtcgggagaaacgctgctggatgaacggatcgaagcagataatgaggcggaggcgaaggccgccggagaggctttgttagaggaaaaaaagcttgagaacagtactcaccgcttggtaaatgaagccggaaagctgattttattccacagataacagaagctttccggcttctgtattttaccggttaaattgcggcgtccgtttttctaaaaaggcgcggatgccctctttatgatcatccgtttttctcatattttcctgggcctttcgttcaagagataaaacgtcttttaaccggctgatatggaggctctgataaatagccttcgtttcaatcatcgctgacagcggcgcatgcagcaatcggtcgatatacggttgtgcccctccgcagggccgccgctgaacagcccgtcggcaagcttgagccgcaccgctttttcagccggcaatttttcaccgctccaaatcagttttttcgcttcgatctcaccgacgcgtctcattaataaataatggcctcctccgtcgggaaccaatccgatgccgatgaaattcatcgcgagtcgggcgttttcttcggcgagcaccacatcggcgcacagcgcgaaactcagcccgagccccgccgcggctccgtggatggcggctatcacaatttttttcatatcatagagcgtcagcgtaatggattcaatcattttcatgagccgttcatattctcccgaatcatgatccgacgtcatcatctggatatcaccgcccgcggaaaatccccggccttcccccgcaagaggacgataagcgcttcgctgtcggctgccataacgcatgcattttccaattcccggagcatttgttcattcagcgcgttgtaactgtcaggacggttcagcacaatctctgcgatctttcccttttcttcataacgaatatactgcatgtttactccctccttgaatccgcttacatattttgttcaaatgatatattccttcccccgaagcgaaactcctttatttttcaaggtcaacagataccgaaaaatgcatatcatttgaaactgaacatacatttttatatagtgaaattgatatacaaaacaaaaagggggaaaaacaccgataatgaaatatgtgatactcagcttgttactgagcttttttatggtgctgttcccccttcggatgtcgctcttccttcccaattggtgacagaaacagacagccatgtacaaatttcggtctacccgcaggaaacggaatcggcaaagacgccggttcaaaccaaaaccgctccgcaaggcctgtcaaaaggatacggtgcgttatcccggatgatctccctgttatctgtcaaacctcttgatcaattcattgattccacaatggaaaggacatgcgccattccgatacaataccagtcaaattacctccggcatcagaccatttctcattgccaatctgtatttacggtgtaaaaacagtatattccggagggattttttatgaatattaaagaaaacgatctgcccggcatcgggaaaaaattcgaaatcgaaacgagaaatcatgaaaaaatgacgatcatcattcatgatgacggcaggcgggaaatttacagatttgatgaccgcgaccctgatgagcttctggcaagcatttcacttgatgatgcggaagcaagacagattgccgcgattatcggcgggatggtgtacaaaccgcaggcgcttgaatcgattgaaatggcgttcagcgatctgattatcgaatggtttaaagttgaaaaaggggcaaaagcggcagggcggacgctcggcgaactggatgtgcgccaaaactatgacgtgacggttatcgccatcataaagcatgaccagaaaaagtttttaaacccgggggctgattcgctccttgaagcaaacgatacactcgtcctctcaggtgaaagaaagcatctgaaaaaactgatccaagacttcctctccagagacggagtgtgatctgtttatggaccatctcgtatttgaagtcggtacggcgttagttcttgtggccattgcgagtgtcatcgccaataaaattaaattctcgatcatccccttcctgatcattttaggaatgcttgtcgggccgcacgcgccccaggcgggcatcattgatctgacgtttatcgaaagccgggaagtgattgaatttttcggacggatgggcgtcctgttcctcctcttttacctcgggcttgaattctcagtcggaaaattagtcaaatccggacgttcaatcgccgccggcggaacgatttatattctgattaatttcagtttagggctgatctacggatttatcacgggcttttcctttttggaagtgcttgtattggcgggcgtcatcacgatatcatccagcgccattgtcgcaaaggtgcttgtcgacttaaagcgcacggccaatccggaaacggagctgattctcggcatcattatgtttgaggatatctttctggcggtttacttatccgtcgtttccgggcttgttctgggagacgcgacgtctgtcgggggcgcgctgatgtcaatcgtgatcgctttcggatatatgctgctgtttttcattgccgcccggaaattgccgcctctgctgaacaagctgcttgatatccgttcaaacgaggtatttgtcatcgtcattttcgccgcgctctttttcattgccggcttttccgaaacgattcatgtcgctgaagcgatcggcgcgctcttgctcgggctcgtgttttcggagacggcccattctgacaggattgagcatcttgtcgtgccgttccgtgactttttcggcgccatgtttttcttcagtttcggcctcagcattgatccgttttcactcggagatgcggtatggctcgccctcggcgccgttctgctgacgattgccggaaactttatcgccggcatgatcgccgggcgccgggcggggctttctcataaagcatcgtccaatatcgggctgaccattgtgtcccgcggcgaattctccattatcgtcgcaaatctcggcatcgccggcggcctgtccgcttcacttaaacctttcgccgccttatatgttttgatactggccatcttcggccctttgctcacgaaagaatcgaagcggatatatctcctgctgaacagcgtattcaaatggaagacgcctgaaaagaagccgcagaaatcataaaaaaaaactgacctcttcataagaggtcagtttttttgagcgggaagaaattgctgaaaagccgtttttttattaatggagaaatgctcttttcccagaatggtattgatgattttttggtttctgtaaacagacagcttcaaattcgtagcgcccgttccgtgagcatgatcaagattcgttaatgtgaaaaaatgatgccgtctgtcgtccttaaagacaagacgggaatcggccgtcactttaaaccgtttctcatcctcccattcgatatcgggggcgattgccgtaaaccattccggaatatgaggtttaaagccggtcgccaatatcactttttctgaatcggccgtaaaagtttcatccatctgccattgatgaaagctcagtacacagcgcccgttttgcttttcaattttttcaagctccgccatcggctgaatatacacgtcaggcgaacctccgctgatcgatctgtgatacagggcgtcgtaaatggtggcaagtgtgtcagaatcaatgccgtggcgcagtccgtccagctcagggagtgtgttcagccgttctttaaaaggcaggcggttaaaatattccacataatcaggtgtaaacatttcctgcccgagcttggcggtttccaattctcgaaatccggcggagcgtgtcacccattgcagccggctgcgccggtattgttcatcatgcaataagtcagaaaagatctccgcggcgctctgtccggagccgaccactgtaattgattcggcgccggcgagctcgtctttccggaacaaatattccgtgctgaccatcgtgtcctgacgcgctccgtcatcaatctctgcgggaataagcggttcagaccccgtccccatgacgaaatgcttcgtctgatagacactgatgcttccgtcctcaatgttcttgacgctgacttcataatgtccgccggcatttttcacgccgattacctctgagccgaaacggcatgatttgatttctgaagccgcccagcttaaatagtcgttaaattcccgtctcggaatatcaaattcattaaacgtataaaaccggtacagccggtcatgttcatggagaaagtttaaaaacgtgtagcggcttttcggatcggcgagcgtgaccaggtccgccagaaacgccacctgtaaatccgttcctttaattaatagaccgggatgccacgcaaattctttctttttatcgaaaaaaagagcgtctgttccgggtatatcctctaacaatgcggcaagccctaaattaaacggcccgattcccgctcctatgacatcatacatattatgcacctcttgcgaataacagtctgatgatcttttcccgtttttacagacggttaaacataaaaaaacggcacgctgattccgtgccgtttttgatattataatgcagatttgacgaacatctcatctaagtatttgattttctcttctgtataatgctcgaatcggtcattatatgatttcgggtctttcggattggcgaagtgcgtgatttttccggtttccggatgaatgaatttgcttgccgccccgcagccgataccgataatcgtctgcacttcttccataatcataatgttgtagatgctttcctgacccgggaaggagtagccgacattttcaaggtttccgagaatatttttctgccgatacaagtagtacggcgtatagccgtgctcttttgtccagcggacggcgtcatccatcatgcgggacacttcctgtctgtcggcaactttatacttatgcttgtttctcgtcatttctgacgcccgtttaaaagaaagcgtatgaacggtcaaagattcaggcatcagcttttccgtttcttcaagactgtgcctgaactcagccgtcccttctcccggcaggccgatgatcaggtccatgttgatattattcatgccgtgtttgcgggaaagatggtatttttcgatggtttcttcaacggtatggtgtctgccgatagccttaagcgtttcgttttcataagattgcgggttgatgctgattctgtcaatcttatacttatttaaaacggcaagcttttcctccgtaatcgtgtcgggacggcccgcttcaacggtaatctccctgatattcgcgacatccgggaaagagcggaccatttcttcatataaaagatccatttcttcagcggtaatgcttgtcggcgtgccgccgccgaaataaatggtcgtcactttgatatcatgccgcttcagccattctccgattttctgcatttcatagtgaagcccccataaaaaggagccgactcttcccgcctgtccttgaatggcataagccggaaacgtgcagtaggcgcacttcgtcgggcagaacgggatgccgatataaatgctgacttcatctttgacccggtacagatcgggaaccgcagcgagctggcggtcgacaatctcctgcatcagattgattttttcatcatggatcagatagtcttttttcagatcggcatgcgcctcttcttttgtcaggccgctctgcagctttttatgaagaagtttagtaggcctgatgccggttaagattccccatttttgtgtcatgcccgtatgtgattgaagaagatttaagtagacatatgacagcgtgtttttcacctgtttaaatacttctttttcgctccatccggcaagaagcggtttcgtgtgatgttccttttcgccggttcctttgatttctccggataccgacacgctgtctgcatcttgagaaatggcaagtgagatgacgagatcagagggttcctccgtttcgccgtacgtaagaacacactcttcaaaaaataaattcgcgatgttttgcagcggacgatgcagcctgtcatccgttatgccgtctatttttatttgcaatgtgatcaccttatttttcagattcaaaactttctttagtgtacagaaagaacaggctaaaatcaatccgcgaaaaagccgcagaccggcgtttcgcgtctgcggctcttgattacggccgtttcatatggaacttatcgagaaagcctttgcggtgctgcatgcggaaatattccttaatcatataagccactccctgttcatcatttgaccttgtcacccagtccgcttttctttttaattcatttgaagcattccccatcgcgacgccgagaccggccagctcgatcatcggcagatcatcttcctgatggccgatagccacaacctcttccattgaaagcccgagatcagcggcgaccatcgaaagtccgctttcttttgaaacccctttaggcacgatgttcagtttttctccgttgacgcggatcacatcgacggccgggaatgctttcattatcgtatccgttatatcagcctgcaggccatcttcagcatgcacttcaatgacgggcgctgaaaccggctcatcaaggagcaggtcacttaatgattcgacaaactgcaccggataaaagatcgggtcagacggatgaatcatcgttttcccgaccagattggagttcactttcttcttgttaccgatcgaatatttttcgtgaagaagccggatattgcattgatagctttcgagcacctgaacgatattaaacgtgtgatcttctgatattttcttttcaaaaaacggctcatctattttttcagaaatgtatgcgccgctgtgggtaatcaattttgcattcagctttaatattttcgccactttttgagcggagcgaaaatggcggtttgtgaccagtgtgacgtaaatcccttttttcttgacgtattcgatggcatcctttgtcgtctgatgaagtttgccgttggagcgaagaagcgctccgtctatatttaacgccagcatttgttttgacacagagaagtcccctccttgatgactgtacttgtcattaggatatgaccctgtctctttgtttagaacaaccttttctccgcagcaaaaaagcctgcctcaagcagactttgaactgtcgttttgttgggatacgatcgatttgctgccttctccccaatgtgcatttctattaacgaaatatatcaggaaccccttatttgaccgttgatgcgctcgtttcacttactctctgttgctaccccttaacataccaggcagtataggcgaccgtatccttagatcatctgtaagtgtaggcgctttcagagttattatctcaataatattgttaaaaaacaagggtttttttaactaaaaaaatcaggggaactatctgtgctgaatgtatgataaaattgaaaaggaacgtatattcgcatataataaaagaaaaaaagcggtgactgtcatgtctctattaaaagatatttataacgaagaatttgcagaagcacttctgcacagagtcaaatcggcgtatccggcttttgagcgggacaagtgccgggcgctgatatttcaggaagattggcccggactgacgttaaaacagcggatgcgccggatcacagactctttatatgaaacactgccgaaggattacatacgggcgcttgacgtcttatatgagacagctccccatttcacagggctcgccgggattatttttcccgattatgtccaacagtacggaacggatcactgggaagaatcaatgaaggcgcttcagtttttcactcgtttttccacttccgaatttgcggtccgcccgtatatcaggcttgaccgggagcggatgttcaaagagttcctttcctggacggagcatccggacgaacatgtcagaaggcttgccagcgagggctcaagaccgcgcctgccgtggggaatctccattccggctcttcttgaagatccttctccgattctccctgttctggaccgcttgatgcaggatgactcgttatatgtcagaaaaagcgtggcgaataacctgaatgacatctccaaaacccatccggatcttctggcacagaccgcagccgagcggttcggaagctgtccgcacacggattggattttgaagcacgcctgcaggacactgttaaaaagaggagacaaacaggcgcttgcgattttcgggtttgaagacgcctcccggatttcattggaacgttttacactgaattcggaaacggccgccatcggaacaagcatacatttttcttttcagatccgctcagccgcccggcaaaaagtcagggttgaatacgcgattgattttgtaaagaaaagggggcaccgcagccgcaaggtgtttaagatgtcggagtccgccatggataacggaaacgtaaaagccttcagcaaacgtcattcccttaaagatttaaccacccgcaagcattatcggggaattcacactctgtctgtcatcattaacggaacggtaaaaggttcgcttgatttttctgttgaataaaaaaacccctccatttcatagatggaggggtgtggagcttattgcgggctgccgtaaagctcttcaagaggtttcataatgattttgtttaactcgccgatcagcatgctcatgcgctgttccgcttccatcagctgagaaatcaattcatgctgctgtacgagagcaaccgttttttgtgcctgctctacctcttcctgagtgatttcttcacctgacatctgtttctgctgcagctgcatctgtacattgcggaagttatcaaacatgcgttttgcggattcatctgcgtttacttgatcataaagccctctcagacggctgtattcatcactgtttcgcaaagctttttcaagatcatatgctgcatcataaaaatgaactgccatagtaaccgctcctttcttcctttcggacataccactccactataacagactgcggagcgactttcatcatcggcgtatgttttccttagaaaagaatgacaaacaaagcctgaattgctccgattatcccgccgagcagaccgcctaaatacgttatcatcttaaattctctcttggaaatcgacagcaccatttcttccagccgttcaacgggaaactgatcaacctgctctttgaccacttcctcaagacgcagccgtttcagcacatcctccaaatgagcggcaatactgccgagtgccgcatcaagcagcttcggcgcgtacgtccccgtaatctccccttcataacgggagatgatgtcaccgagccggcattcgaaaaagggcgcggtttgaagtgcggccaaagcccgctttttcatgctgaacagcagatctttcgcattccacttttcatcggcctcataaagtgtataagatttgagcttgccccattcttgagaaagcagatcagccagaagctttttcgtttcctcattgcgcaaaaactttaacagctcaggcagcacacggtctgccaagcttgaattgccgaggaacatctgcaccatgccgccgagcatccccgggaattcaaaaagtcgtcaatcatatttccgagtctgtctttcccttcttcgctctcaaaataatcaatgctacgcttcaggatataatctgcggccagcgggattttttcatccagcttttcctgcagctcatcaggaagccagtctttgatggcgcggtgctcatatttccggtacaggtccgaaagcttttcatcggtaaaacggtcaatccaggcatccgtcttttcctgcggattccggatgcccgcggcggccaaagcttcgtgcaccgtcatttcggaagcggccattttttgcgtgaattgttcggcgaaaagaagcgcctggtttttaacgttatctgataaaagccgcttttttattccttccggggttaaaaggtggttcgtcaccatgagccccatttgttttgccaattcatcccgtcttttcgggatcagccccggcgtaaacggaacccgttttccgaacaggtaatacggccggtacggacgaaataacatctgaatggcaagatgattcgtcaccgcgccgatcgcggctccgatcacgatcataaatagaaacgttcctgctatgcccattccttttcttctgcctccatcttatgttctattttcttgatgatatatctattcgtattatagaggctggcgggcatgcgggcaaatgaagaacctgaattgttgtttgtgaggaataaggcaagatgctgtttcgtactctttacagtagatcatcttttatgatgcgcttagcatatttattggatggaagggccgttccatcagcggctttttgaataaagggggagtagtaatatgacaacactcggttttatgtctgtatcccgccggcacgaagaagattacgccggggaattggctgaaagagcgcctcaatataatgtgcgcttagcccgctttacaccgtttgatatatttccggattctttgcgcgtgaaagcgctcgtctatcacccgcaaagcggaaagtggaacgaaacggaaatcgatattcccgaatatatttacgaccgctgtttttacggaaaatccgctgaagcgcaaaaagccaaaccgatcgtcgaatggctgaaaaaatatccgaaaacggaatttatcgggcgggggcttcctgataaatggacggttacagatgcgctccaaaagcatcatctgatcagtccctatattcctgaaacggccgaagtcagccgctatgaacaggtgcaattatacttagccaaggaaaaagcatgtatacttaagcccgctttcggcgcgggaggcagaggcatcatcctgcttgaaacaggcaaaaaatcaattaccgccacttactatatcggaaaaaacaaacaaacaaaatcattttccaatcacgtgtcttttaagtcttggtgcaaaaaagtgctgcagcaccgctatttgcttcaatcctacttaaatatccaggataaagaacggcatccgtgcgacatccgcattttcatgcgcaaaacggagtcaggcgtttgggaaacggtcggaaaagcggtcagaaggggttatcagaacggtcttttatctcatttgcccggaggatcagaaccgattaagtttgacatatggtttgaggaaattccgagaaagcagcaggccgttttattggatgatgtcttttcgatcacccaatccgttccttatttccttgatgaacggttcggaccgctgtttgagctggggctcgatatttgttatgccaaagacggacgcatctggcttttggatgtcaattcaaagccgggacggaaagctattttaagcgtggctccggaggcgaaagaggatttgtatacgggtccgctgagacgcttccgcgaacttcagtcacaggacagcaggaagggagtattaccgcgtgaatcataaagggatgattgtcggcatcgataaaaaaagcaaaaatacgctgtttctcccctcctccatgaaacgggaagggcttttatccgctgccttcgggaccaaggttgtcaaatgccgtgtagccttttctcaatcacttgaaaaaagcgcgctcctttctgaagatttgtttgaggagctgttgataccgtataaaagccgggctgactttctcatacacggccagacggtgcacatcggaccgctgatcggcgttttcacagccgggttcacatcatcgccgtcccgcccgttaagagaccgtacagccttcttttccaagatgctctcacttcatgaacaggcgaacggatattgtttcgttttcggagctcatcagatcaactgggaagaaggcaccgtccaagcgctgatttataaagaaaacagctggaaacggacgtccgtcccgcttccgaatgtcgtatatgacaggctcccgagccgaaaaacggaaggagttccgcttttacagcagacaaaacagaggctgatgaatgactatcagattccgtggtttaatccgcaattctttaataaatgggacattcataagcttctggaaaaaaacagtctcaccgcttcacttcttccaaaatctgtcctgcacccgaatgcagaggcgttagagacgttatgcaacacatttgacaccgtctatatcaaacctgcagacggcgcactcggaacggggatttacagggtggaaaaaacagatgccggcttatctgtcaaacacacgaatgaggaaaaaacggtggtgacggcagagtattcagatgcggcatccttcatgaaatcatttaaagaaaacaatgacccgtccgcatttttaattcagcaaggcattgacctgatccggctggatggacgccccgtcgatttcagggtgcacacgaataaaaacgccgaggggaaatggacagtgacggccattgcagcaaaaatttccggtgaaaacagcatcacgacgcatctggcaaccggcggagaagtcaggacgttagctgaattatacggcgatccgcgagagagagtcggcatgatgcggaaactttccaaagccgccttggcggtcagccgcgtgttaaatgagcacattgaaggttttatcggcgaaatcggttttgacctcggcgtcgatcattcagggaaagtttggatgtttgaagccaattcccgccccgggcgcagcattttttcccatccgaagctgagatcggtcgattacctgacaaaacggagaaattttgaatacgcgtcctatttatcagaacggtccatcaccgccccggaaaaactttggcggtgaggctgtctttttttggttttacccgggacaggcacagaatgatgagctacaatgaacaagatcaacatttcctacaaggagcgtgaacgtcatgatttcgcacttcagctggaaaccgttattcaaaaaagagaaactgcccggatggcggatttcattttactggcagggtacgcattacgaaggggtttaccataagtccggtgacattgaatggggacacacacatccgggaaaagaagagccggctctcgtaaaagagctgcacgaattaatgctttatcacatatatgactgaaagctaaaagctcagccgcatcaggctgggcttttcttttcccttccgctatttaccacccggttttccgaatgagatgccctttgattcaccataatacgtagtacaaagcggcaaacagcattgggtgaagccgagctggcaatggttttcattccgaaaatcatcggctggtgcaattccagcaaacccaaccatactacttaataaaggagatcatacaaatggcaaacaacaactcttcaaaccaactattagtacccggcgctgctcaagcaatcgaccaaatgaaatacgaaattgcttctgagttcggcgtaaaccttggcggagaaacaacttctcgtgcaaacggttctgtcggaggagaaatcacgaaacgtttagtatctttcgcacagcagaacatgggcggccaaggcgtacaataactcaataaatggcttacagaaggcgcgggataccgcgtcttcttttatgccgtcacccttttttcctattccacataccctaggaaaaaaggagggaaaacatgtcattcattgcctcagtcaattgggagctgtttcagttcgtaagtgtttctttggtcaatgaatatgttgcccaccatttcccgtttattcacaggcattcttttccccgctgctttgaatgatataatgagcggcgaggaggttttttacatgaacatcgctttactcggagcaacgggaagagtcggacaggcttttataaaagaagcgcagaaacatggacacatggaaatattcgctcttgtcagatcagccggaacagtccttcccattcctgaaaaacagatcataacagggaatgcgaggcggcgggaagatgtcagccgattgatttccaaagcggacacagtcgtgagctgtctcggcacggacggtgacgataccctttcagccgctatgacccatataatagacggcatgaaacggcatcatgttcagcgtctgattacgatcggcaccgcgggtatccttcaatcacggcttatgcctgatcaataccgttttgaatcggcagaatcaaaacgaaaatcaacaagagccgcaaaggaacacgcccgcgtatacgagatgctgctggcagaggatcttgactggacgatcatctgccctacctaccttcctgacggagacgctgccggagtttaccggttcgaacaggatcgccttcctgaagacggcgccgaaatcacagtcggagacacggcacattttctgtaccgcgagctgatcagcccgcagtttgtcagaaaacgggtaggactggcttactgaatgaaaaaagggcgaatcttttgattcaccctttccgattacaccgcggatttcgccgttcctttctgtaattcatacatttgatggtactgccccttttgcgccattaattcgtcatggcttcccttttcaatgatgcggcccttttccagcacgagaatctggtctgcgtgtctgatcgtggaaagccgatgggcgataataaatgtcgtgcgcccttcttgaaccacttgcagcgctttttgaatgaccgcttctgtttcggtgtcaatgtgcgccgtcgcctcatccaaaattaaaatggccggatcgaacacaagcgctcttgcaaaagaaatcagctgacgctggcctgaggacagtgtgccgcctttttcggtgacgggctctctgatgcccttcggcaaagattgcagaaggcttgcggcgccgacttggcgaagcgcttcttccgcctgctccagagaaatacgctgatcatcgagtgtcacattggagccgatcgtgcccgagaaaagatacgggtcttgcagcacaatgcccatatgcgacctcagctcctgccttgacatgctgtatatgcttttaccgtccagcaggatatcccctttttgggcatcataaaaacggaacagaagattcaggatggagcttttgccggaccccgtatggccgacgagggcgaccgtctcccctttttcagctgtaaagctgatgtgtttcagcacctcttctccctttcgatatccaaaagaaacatcgcggaattccactgtcccttccgcctttctgtctgcgggagcgccttcttcttccgtttcctcctcctgtaaaagctcgaatactctggcggcagagacacgggccaattcaagcttcgaaaattggttgacaatccccgtaaccggctggaacaaacggtttaaataatcaacaaatgcatataaaacaccgatcgaaacaattccggccgcactcagactcgcgcctccgaaataccagatcagcccgacaaacgccagattgcgcaacacattgacaagactgtgggacatgagggaatttaaggacagcattttgtttttgtagcggaaatgagcttcattcaattcttcaaattccttcatcgtttccttctcgcggcggaacgcctgaataatcggcattccttgaatggactcgttcattttcgcattgatgtcactgttaatggaacggattttttgattgaagacggatgcatatttgcggtacacaaccgaccagatcattaaaatcggaataatcagaaggcaaacggcggccagcctgacgtcaagcataaacagcgccgtaaaaatgccgagcatataaacgccgcttgtgataaatgtcgacagcaccgttacatataaatccctcaccgcttctgtgtcattcgtaatacgggccacgacttttccggcaggcagattatcaaagtagcggatcggcattttctgaatgtgtgaaaatacatcctgcctcatgcgctgtatgatccggttcgctcccatctgcagcagataatgctgaccgtaatgaaaacatacggaaaacatgagcaatcccgcataaatggcggtcaacgtcagcaatccttttatttccggacggtaaaattcaaaaatctcctgtcttgataacgtaatgacgggatatgacctgctttctttaccgtttgatattgtcagccggccgtcagacaccgaacggtttccgtcaaaactgacgggacggtcaacaaaatagtagcccgcaccgacttgataaatgtgcgcctctccggttttatccgcccccggtttgagccggtcctccctgacataatcatgcccccggaacctgacggcgcccggatcgtccgcagaggctttaacccatgttttttcaatgccgagaatgtggtcatcaatcattttttttccgataaacgggccggtcagctcagtgccgaccgcaataatgagcaggacgaccgcccatatcagcagcttcttatattgaagcgcgtaattccataatcttctcccggtcttcatgcgcccgtccccccttcttcaagagaggacagctgctgcctctcatattgttttcgataccagccgttctgcgccaatagctcccggtgcgtgcctctttcagacacccggccttcgtccatgacgagaatgagatctgcgtgttcaactgccgagagccggtgggtggtgataatcgttgttttatgccgccgttttttacggatgctgtcaatgatggcggcttccgttttcgcgtctacggcagaaagcgaatcatctaatatgagaatatcaggatcggtcaaaagcgctctcgcaattgagatgcgctgcttttgtccgcccgagagcgctacgcccttctcgccgacaagcgtctcaagcccgtcggaaagcatgccgatatcgttttcaaaatgcgcatctttcagcgcgccgccgatttcctcttcgtttgcatcctgccgtccgtaaagcagattctcctttacagtcttagaaaataaaatatgatcctgcggcacatagccgatccacccgcggagctcctcaagcgggatctcctgaatcgggacgcctgtaaacgtgacctctcccgcaccgggcggatattcacgcagcagctgcttaatgatcgtcgtctttccgcttcccgtcttcccgacgatgccgagtgtctgccctttttctacggaaaaagatacatcggaaaccgccggtcccgctccgctcggatacgtgaaagtcacttgttcaaaaacaagacgcccgggctccttgatgccggcggggcgcttgggcccgatcacgtcaggctcataggaaagcgtctcattgacacgatccaaggaggcattgccgcgctgcatgatattgattaattctccgatcgcaaacatcggccagatcatcattccgaggtacacgttaaacgataccagctctcccagcgtcagccggttttgaaaaacgagataagcgccgtagccgagacctatgagatagctgaggccgacgagaagtttcacagtcggttcaaaaagtgaatcgataaacgccaccttcatatttttctcatatacatccgccgtcatatcaccgaaccggctgacatcatttttttcctgcacaaatgcccggatgacccggacgccggataccgactccagcaccttgtcatttaatgatccgaaagcatcctgcgcttccgtaaaccgctcatggatcttttttccgtacaggctgaccgcagccgccattatcggcagcggaataatcgcggcaaatgtcagcttccagctgatgagaagccccattgtcaaaaatatcgtcagcatatacatcgtcgaatcaacgagcgttaagaccccgaagcccgtcgtcatactgacggcctgcaggtcatttgtcccccgcgccattaaatcgcccgttctgtatttctcgtaaaacggcggtgacatttgaagaagccttcccatcagctttgaccggagaattttctccatgacattcgccccgccgaaaagctgatacatccaaaaataagacagtaaatagacggctgccgttaatgcgagaaaaacacatatgtaaaacagcatcccgcttttcgtaaacacgcccgccttcatatcgtctatcgcattaccgagaagtttaggcggaaacatctcaatgacattcacaatcaataacagaacaatcgctgtcgtatagcgcagccaataggctttaaaaaaccacgcgagcttttttaatacagtaaacaaataccgtcatcccctttcatcaatcagccgccctcaagcttttccggattgtttttcattgttttcgctaatgccgccacatgcatcacacctgtctttctttcatttttttgtataaaaaaagacatgaagcctcagctccatgcctcttattattataaataaggtacagacccgccgtttatgcgcgactgccccgtttttaagcaaatgttcagaaaacggaagctgtatggaagtcacgccggtattcagctgaagatgagttgacaagctttagttttgacatgatccatacctcctttttcctatattgttccttcatcatataaataaatcctttttttgtcaatgcgggttttacatttctgccgcacgggtattgtaaaacaaaccttttttactgaaaggatgaggctgatgtttcacgcagaccggttgatagcagcttttgacggaagtgatgatagtaaaaaagcgcttcaaaaagccatagacctttcaaaaacgttccacgcggatttaacggtcgtacattcccacagtgcaaaagatacccagacgattgttgatcccccgaggccgggagccggggcaacgtatatcggcggcgggattgcaagcgttcctgacccgcttcaggcggaaagaatctcccctgatccgatgatttatgaagaccgtacggaagaaatcgttgcggaagcgagaatgctgatgaacgacagccagattgacggggatatcgacattttagaaggtgatcccgctgatgccattatcgagcatgccgaccgtatatcggcggatttgatcgtcatggggagccgggaccagaacaggctgaaaaaacttttattcggaagcgtcagtgaaaaactgtcatcgaaatccgatattcccgtgctgatcgtaaaataattctttctgtaaagcagcttaatcaaaagctgctttttttacagctcccggctgttttttctttttttcggcattacaaaaaaactcgccatgatcaaaaaatcgatgcacaatacgacagaccagccctttaacagtccgctgagcgcttcggtgcgggaagcgtcctgaatgagaaataccgttccggctaaaagaacgccgccgatgacaaatgctaatacatgtcttccccatccttttgcataatgtttggcataatccagtccgtaccgcttgaccggttttgccccttcctttaccacataatagcggaaccgctcatccgcccactgaatcatgctttttccgaaggcgacagacactccgatataaacggccgccactgcatgcgccatagtcgccgccgcccctctgtataaatcagctgcggccgccagaaacagtacggcatccaatataggaatgagagcgaaaaaaaacattccgagcttttgccgcctgaatatatagcgcgccgccaatccgaagatgacagccgcccaaaaagcagcctcacaaatgacaatcaaccaagcaatcgcgttcaatccggttcccccttatcgttttctaaaatgcattgtatcactgctttttatttaatacaactgtattacaaaattgcaagaaaaaatatttcctgttacactggaaccatgcctaaaataatcgatcatgaaaaaagaagaaaacaaatagccgaagccacttggcggacgattttggagcggggaatggaaggagcgacagtgagaaacatcgcccaagaagcgggtctttctttaggcgcgctgaggcactatttcaccacccaggatgagcttttagggtatgcgatgacactcgtaaaagaaaaagcggccgccagaattaacgaagttgccatgaaagatctgccgccgaaagaaaaagcggtgcgtctgatgcttgaaattatcccgacagatgaagaaacgatggctgaaatggaggtgtggttcgctttcacagcttatgccagacataagggagaagagtttcaaccccagcaggacgggatcttggcatatatccgcggcctgattgactggctggatgaaaataagcttctgaaaccgaatcttgataaagaaaccgaagcggagaaaatgtacgctatcgccgacggattggcgctgcatgccatgcttgaacctgatcgtctttcaaaagagaagatctcccgtgtactcgttcagcatatcgaatctctttttatctgactggagcaaaaaggccggatgtgttccggcctttttttcagcttatgactgaacgccgagctcctgctgaatgtgcgactgaaaagcctcctgaatcgttttggctacaggtcccggcgatccgcttccgaccggttttccgtcaagggttacgatcgggattaattcagacgtggttgacgagatgaaaatttcatccgcatctctgagttcctcttcggtaagagccttctcccgcacctcaatcccgttttctttcatcagctctaacagtttcatccgcgtaatgccgtttaaaatcagctcatttgcaggatgcgtccggacggtgccgtttatgacggcgtatacattggatgaggttccttccgtgaccgccccgtcccttatcagcacggcttcataagcgcctgcttcataggctttttgttttatcatcacattatacagtaaattcagactcttaatgtcacacctcagccagcgtttgtcttccgccgtgatggcctgcgctccggctttttgttcattttccggttttttcactgaaaaggtgtatgccgtcgtctgcggctccaatccttcgtcatactggtgcttccgcggcgccttccctctcgtcgtctgtatatagaccccgccgtcaatgagtttgttttcctgtacgagcttttgcagatcccattctatgtcctctgcggagaacggcagggtgatgccgatttctgcggcgcttctgaaaagacgggcgatatgctcacgcagaccgaataaggcgccgttatacactctgatgacctcatacacaccgtcaccgaattgatatccgcggtcctcaatatcaactgccgcttcttcacgatcaatcaactggccgtttactaatgtcttcatgtaaaccctcctaatcgttatctgccgtgatgtgcattctcagctgttattgtcaactattctatcatactgaacgagccggctgcggagtttatttttttcttaaaatcttattattcgacatcttttctatgtcttttccagttttgttcctgtatacttgattcgacatacatatgctgttaacttatggcacttcgcaagcctccgctgttatcggcattatgcagaaacttatgctactggagagattgttatgcgcaacacaaaagaaggtgcttccccttctctgttttcattggcttttaaacttacgagtttagcagttttgtgcggactgcttctggtaatcgtcataatgggatattccgcttccgccgcaaaaaacaaacaggtcaccgtgaccgcaaacgggcagcttcgggatgaagcagaaagcctgcggctgaaaaatgattctcccgacgtcttaatgaaacatttgcagaaagagcgtgacccagggaaaaaaacggtatatttaaccttcgacgacgggccgtctccatatactgaacagctgttgaatgtattgaaggcaaatggcgcaaaggccactttttttatgcttgaaccgcggatgaaagcctataagcattccgtgcaaagagcgaagcaggaagggatcgcgctgggcctgcacggcgtgacgcacgataatcacctgttttatcaaacaccgacatcaccgctgaacgaaatgcagcagggacgcgatacgctcgagacaatcactggagtaaaaacggatcttgtccgcacgccttacggcagtaaaccctcattgacggatgcccagattaagaatctcgaaaaagacggattcgtgtactgggactggacgatagacagtgaagactggaagtacaaaaacgcgcggtacgtgccggaagtattgaatcagctcgcatatttggaaagcgttcatacgagcaggccgcatgtcattttaatgcacgatctgcctgcgacggtgcacgctttaccgagcctgatccaaaaactgaaagcccagggctactcctttgatgttctgacggatcaaatgattcccgtccatgaataagaaaagccggatctgtataggatccggctttttttatgtcgcggcgctgatccgttttgcaaattcaccgatcttctcatggatgacaagatcaaataaatggtcgcaatatgtcggctcaaggttaatgatcacttgcttcaaaccgggaatccggcccgcatcctcagggacaaaccttgccggcgccacttcaagcgaagtgccgatcacaagaagaagatcagctttatcaagcttttcataaagggtttcaaaatgctgaacgagatcgccgaacagcacgacatccgtctttaatacggtgccgcataccgcatgatcaccgacttcggccgtacattccggcacttcgtccttcagcagatgagaaagcccgtagcgcgctccgcagcgggggcatgcggcggtctgaattgaaccgtgaagctcatagacactgctgcttcccgctttcttatgcagtccgtcaatgttctgcgtgaaaatgtctacctgctttccccgcttttcaagatccgccaaatacgtatggccggcattcggctcatagcttccgctcattttcatctgaaagagctgtttgaatttaggccagaattcacgcggacggcgttcaaagtattccctgctcatcgcttccattctggaggtgtcttcggtccatataccgcccgccgaacgaaaatcgggaatgccggattccgtgctcattcccgctcccgtcagcaccaggatacgttcagcctgattgatcaatgttataaacgcttccactcttccaccgccttttctttttatcatatcatgaaaaaagaacggcgcctgttatgcccgttctttttctccggaatgatccttcacatgaaccggatcatcgtggctcttctgttttacgaatacattctggcccggataggcgaactccacgccttcctcagcaaaaatatcaataatccggcggttgatatcctgccgcacgtccaggctttccgcccagacgatggtctttgtgtaaaagttgaaaaacagattgtaatagctgtccgcaaacacgtcaaagttaaccataatcgtatcatcatgcacgccttcatgttcacgaagcatttccctgagccttgtgatgcaccgctctaaacgatcaatcggcgtcgcataagaaacacgaacggaaaacgtgacctggcgcttcgtcatcctcgtccagtttgtgatggcttccatggacagcgttgaattgggtacggtaacaagcgccccctgcgccgtgcggaaccttgtgcttcggaatgtgatatcttcaacgccccccgtcacagatgacgtctcgacccagtcgccgatcgtaaacggcttttccgtaatgatgataatgccgccgaaaaaattgctgatcgtatctttagccgcaagcgcgaaggccaagccgccaagtccgagtccggccacgaacccgtttacatcataattgaattcctgcgcgatcacactgacgctgagcgcgagaatgacaaagcgcagcaccttggataaaaacggcgccaaaatgtcatccatatcaagctcaaagcgctgattgactttatgaaataaaaacgaagacgccgatgtcagattgcaaagcccccaggcgatcagcgctatgatcaaagagcggtacatttttttgacaatgtccatctgcccgtctaaaaacggcgaatactcaatcgccaaaaacagacccagcgccacgaaaaaccatctggccggcttgtcaaacgctacggcaatctgtttgaatatgtcggttttcggcttgttcgccaatttgtaaatgagctgaaaaaagtatttgacaaacagttttctcaaaacgagaaaagccgctaaaattccgatgctgatactgatctgcaaaatatggtcaagagtaaaaaagctctgaaattgtgtcatcatggcatatgctcctttgtcttgtcgaaaatctattatactaaaacattcggacatcagcttgttttaatgtctttaggcagcctgaaaaaccccggcctcagagcacagccggggtttttcacacattcgttcatctttcagccagatacaacagggtcaggcactatttcttctttgattgtgtctgtttcaggagagtcgctttttggatttcagcatcggtttcggccttaattctttcttccactttcaatctcccttttcccatgatctcgcctcctttttgccattataaatcatcactgcggattgtaaaccgaaaaaagcactatctttattccaaaaaaatactgttttgcacattcaccagtttgaatcgctgtgcatatacgaatctgatataataacagaaatgcccatgaggggagctgacaagcttgtataccatcgctcatcgcggcgcatccggttacgcgcccgaaaatacatttgcggcatttgatatcgctgccgaaatgaacgctgatttcattgagcttgacgtccagctcacaaaagacggccagattgtcgtcatccatgatgacaaagtcgaccggacgacggacggctccggttttgtaaaagattttacgctgaagaagctgcagtctctggacgccggcagctggtatggggctgagtttaaaggggagcggattcccctgctcgaagaggttctgaagcgttatcattctgaaatcggatttttaattgaactgaaagggcacgtttctcaagtcggtcttgaaaaagcagtcggccagctgttaagcaggtttaccttttccattcaccctatcgttcaatcattcagtctcaagtcgattcagacctttcacgacatgtatccgtccgttccgactgcaattatcgcaagacccagcttcgggatgttttccaaaagccagctggccgcttacaaatcagccgcaaattatgtcaatattaaatatacccgcctgaatcggttcttgatttccaccgctcacaaacacggcctgaaagtatttgcctggacggtcagaaatcacaagacggccgaaaagctgcaaatgatggcagttgacggcattgtaactgattttccggatattatttctaaggatggctgatatgaaacaatacatcgcaatttttatcggaggcgcgcttggcgcattgctccgctttgaaatgagcgcgcacattcacagcggaactttcccgggtgccactttcctcgaaaacgcggcgggaagccttttactcggtcttattacgggttatttcatcattcgggctaaacgccctcttttgaccgcctttttaggaaccggtttttgcggaggtttcacgacgatgtcaaccttcgcaaaagaaaccatttttctgctgcaatcgtctcccgcagcggctttttgttatgctgccgcgactttattcgctggtcttgctcttgcatacgccggcatttttttgggacggcggattgcccttcacgcagccggaagggggcatgatacgccatgacgattgtcctgatgcttatcgcggcgggtatcggagcggtattacggtctctgctgggtaagacaatttcagaaagaacaaaaggttttccgattccgcttggaatggctgcggtcaacctgctcggctccttcagcctcggcatattcaccggcttgggtctggataatccttctgccggcgtcatcatcgcgacgggctttttcggtgcgtttacgaccttttccaccttcagtattgaagccgtgcagctgatgatgaacaaccgcataaaggaaagcctgctctacatcgctgtttcagcagccggaagccttttggcgttctggtgcggctttgttatgatatccatttaaaaaaaccttgagcttatttttcgctcaaggttgcgttatgaagcatgaccgtttccggcacgggcagcgggcggtttattgtcccctgaccgcccgggcggccctgttcttctttgagttcaagctgtttaataaaccggccgtccatttctaatatgagggcagtgtatcccccgatttgtatcgactcacccgcacaaatgtcaatattccgtttcagcacaagaccgccgatcgtgtcgacttcctcttcaatctctgcgccgagaagatgattcacctgatcgatccgaacctttccgtccagcacataatggcgttcggacagcttttgaatctgcggctgttcgtcctcatcaaattcgtctctgatatcgccgacgatttcttcaagtatgtcttcggtcgtcacaagaccggacgttccgccgtattcatcagacaatatcgccaaatgaatccgttctctctgcatttttatcagcaggtcgtgtatcgggatcgtctcgatgacttcaatcaccgggcggacgtaagacatgatggatacttccgctttttcatcttctgtcataaacagcagatctgaaaagagatgcttcgtattgatcatgccgatgacactgtctttgtccccgtccgttacgggccagcgcgtatatttgtctttcagcatcatatcaagcatttccggcacgtccatatcagtggaaacagccgcgatttcttttctcgggatcatgatttccttggcgatccgattatcaaaatcaaaaattttattcacaaatgtatattcagacggattgatttctccgttttttaaactttctgacagcaggatccgcagctcttcttcagagtgggagccttcatgctcagatgccggctttaatccggccaaaccggtcagaattctcgcggagccgttcagcacccaaataaacgggaacatgaacacgtaaaataaccgaagcggtccggcaatccataacgtcagcttttccgctttttgaatcgcaaccgttttaggcgcaagctcaccgacgacgacatgtaaaaacgtaatcagcccgtacgccgcagcaaaagcaatcacatgctcggcagaatccggcagccccataccctgaaacacaggatgaagcatccgctcaaatgcaggctctcccagtacgccgagcccgatggatgtgagtgtaatgccaagctgcgaggcggataaatactcatcaagatccgtaatgatacgctttgcgagcaccgcccgtctgtttccttctgagatgagctgatcgattctggatctcctcactctgacgatcgcaaattcactcgccacgaaaaatgccgttaacgcaatgagcacaccgattaaaatcaaactgtcaatatcgtccatttcaccttatcccgaattgaaggataaggacgtcacctcctgatttcatcgttttttcttaagcgagaggaacgaaatgggtgattgactacacagagggccccatcctgccacctcctaagtcaaagcatgattgtcatttgtatagtttattgtatcacaactccattctttcatcattttcagatttttcatcatataaaaacagccttcaaaaagaaggctgccgttatctgcttcggaaatgattttctaaacaaagcgccgtattaatcccccgaatcccatgcttaagcttaacgcatggtgtacggtatgggcgctcggcccgtcggtcacccactgaaatgaatcgtcaatcggctccgttaagtttcggatcggatgaagcttgttttcccgcatttgcaagagaacagcaatgatttccaccgttccggccgcactcagaccgtgtccggtaatcgattttgtcgcattaatccgcgcgtgcgacaggccgctttcagaaagcgcccggcattcagtcttatctccgatcggcgaaccggtgccgtgcgggttgatgtaatcgatctctttcgctgaaagaccggcccgctccagcgcctggcggatcaccgtcatttcgccctctgctgaaggattcgggttgcggttcgcatcggaagccatcccccagccctttaagccggcccacgatcgtgcgcccctctcttcggcagattcagcgcgctccagcacaatcgccccgcacgcctctccgaatataaacccgtccgtatgccggtcaaacgggcggcaggcggcttcaggccgttcagcgtatgtatcagtgcccatcgctcccaaagaacggagagcgtgacactccatgtacgacagatcggccagcgccccgatcacgatgcaccggtcaaacaggcctcctttaattccttgagcagcctggataaccgccgcctggccgcttgccgacgcgccgccgaccgtaaaggccggcccttttatcccgaattgctccgtgcaaagccccgacaaatcactatccataaaagaaagcccgtatgtcggatttacaaattgcggcgtttcaccgtttttctcaaaggcctgcagcaattcgcgctgcgtcatattcgacccgccgatgatcagaccggtgcggctgtgatcagcgccgtctaattgagcgtcatgccacgcttcatataaagcgataagcgccgtctttcctgataatgcggcccttcggtacaagcgcttcgacagcgcgtccggcggcgttaattcgctaagctccgcgccgataaacgaactgcctttctgccggccgggacgtttcatcacatcaaaggcgtgccgcccctccatgagcgcatcgagaaacgcctccttgccttgtccgaccgcggttaagactccgattcctgtaatgctgatgtctgatgtgccattatttctcctcgacatttgtccgttctcccatctttatgtgttggaagctatgaagaaaaatcttgatacagtgctttgaaaatatcgcgcgactgtctgatctgttccgaaggcacgctgaaagataatcggaaatagccgctttttccaaatccgctgccgggtacgatcaatagtctgtatttctgtgcggcatgcatacagaacgccacctcgtcttcaatcggtgatttcggaaagacgaaaaagcctcctttcggcatttcaaattcgaagccggcttctgtgaggatgtccaccataaggtctctccgctttctgtaaggttcagcgtcaatcgaaagatcatccattttcgccacggcgcgctgcatcatgaccggagcgttcacaaagccgagcgtccggttgcagaaaacgaacgcatccgtcagaagatcgccctcaggcatttgggcgtccgccgcgatatacccgagcctttcccccgcaatgccgagatctttactgaacgaactgactaaaatcacgcggtgatacgcctgaaacggattcgcctgctcttctccgtagatcagctggctgtacggttcatcaaataaaataaatatgctttggccgttccgctcttcggcttcttttaataaggcgcctaattcgttaaggtttttctggctgagcacagtccccgtcggattatgcggcgtattaacgatcagtcctttcgtacggggtgtgatcgcacctttaaccgcttcaatatcaatctcaaatgagtcagtcagcgggcagatgacgggtctgccgcggtaattttcaacatacgctttatattccgcaaaataaggcgaaagaaggatgacttcttcctccgggtttaaaatgctcttcagcgcgacattcagcgccccgccggctccgaccgtcataactgtatgcctggcggaaatctcggtctgaaaccgctctgacaaaaagcgggcaaccttttctctcgcctccggaagcccttggttttgtatgtatccgtgccgccctgtttcagccgcttcgcaaagcgcctttttaaacgtttcaggcggctccgcaaccggatttcctattgaaaagtcaaacaccttatcggcgccgaactcttttttcagccgagcgccttcatcaaatagtttgcgtatccatgaacctttctccaggttctgtgtcacttcccttgataaaccggccactgtcatctgtcccttctgtctttttctgccgtttctatttacaatgattatgaaagatttacatggcgcagtcaacgctttttcagacagcctgccgccccgtttcaggagaaagacggaaaacaataaacttgtgcaaactccccttcatatattaaactattctcataactataacgtgatggttggggagggatttagatggggctgagacttatcgcatcagtgaattagcagagcttgccggtgtaacgaaacgcacggtggattactacacaaacctcgggcttttaaagcctgacaggtcttgttcgaactatcgttactacgatacacttgcacttaatcggttaaagtttatagtcgcttgtaaaaagcagcgattggccctgtctgatataaaagatcgactggagaaccagtttccctcttcagccctgcctgacgatgttggaaatctggcatcggaaattgatcacatgaatcaaaacatctccgggatcttgaatcggtttgaaaagcttgaaccagaggagcgcgcccagctgaaaaaaaggctggctcctgaaaagcttgcagtgcttcaatcatttatgctgctgttaagttaaaccattatcttactaacaggaggtgttaccttcatcttcccaaaaggagtgaaggttctaattggacattgtgaatttgattttagtcgcggttttaatcgcgctgacggcatttttcgtagcatctgagtttgcgataatcagaatcagaggctcacgggttgaccagcttatagcagaaggaaataaagccgcaatcggtgtcaaaaaagtgaccacgcatttagatgagtatttatcggcgtgccagctcggcataacattgacttccatcggtcttggtgtcttaggcgaatcaacgattgaacgcttgcttcacccgcttttcacaaagataaacgtaccaagctcattatcgcatattatttcatttattctcgcctacgcgatcattacattcttacacgtggtcgtgggagaattggcgccgaaaacagtcgccatccagaaagcggaagccgtttcaatgctgttttcgaaaccgctcatttggttttaccgcatcatgttcccgtttatctggcttctgaacaactccgcccgtcttttaacgaagacgttcggtctggagacggtgtctgaaaatgagcttgcccactctgaagaagagctgcgcatcattttatcggaaagctataaaagcggtgaaatcaaccagtctgaatttaaatatgtgaacaaaatctttgaatttgacgacagacttgcaaaagaaatcatgattccgcgtacggaaatcgtcagtctgccgcatgatatcaaaatttctgaaatgatggatatcattcagattgaaaaatatacccggtaccctgtcgaagagggtgacaaagataatattatcggcgttattaacattaaagaagtgctgaccgcctgcatcagcggcgaagtatcagtcgactcgccgattacggattttgtcaatccgatcatccatgtgattgagtcggcaccgattcacgatctgcttgtaaaaatgcagaaggaacgggttcatatggcgattctgtcggatgaatacggcggaaccgcggggcttgtcaccgttgaagacattattgaagaaatcgtcggggaaatccgtgatgaatttgatatcgatgaaatcaatgaaatccgcaaactcggcgacggccattacatgcttgacggcaaggtcctgattgatcaagtgaacgaactcctcggcatccatttggaaaatgacgaggtcgacaccatcggcggctggttccttacccagaaatacgacgtcgaacaatacgactcgattatcgaagaaggctgcgaatttatcattaatgaaattgacggccaccacgtcgcatatatcgaagtgaaaaaactggcgtttgatgaactgctggaaactgccgaacaaaaagaagcataacaaaaaagcttgcgcgtctgatacagacggcaagctttttttcatttacagttgttcaagttttttctcaagctctttaattctggcattcagctcttctgtcatggccgcaagcctctccttcggcgcaagatcggaaaagtcctccaaaaaaatcggctcgccgatgataagccgcatttttccctttttaaacagcgcttttcccgtagacggccctttatatgcggccggaacgagcggcgctttccccatttgggcgatggtcacggcccctcttttcagcgggacgtcttcagaagttctcgtgccgctcggaaaaatccctacaatcttcccttccttcagaagcttaatcggcgttttaatgctgctcggacccggattttcacgatcaaccggaaacgcgtgaatcttctttaaaaaacttccgatccactttttctgaaacagctcttttttcgccatataatgaatctgatggggcaatatcccgacaccgagcgtgaggacgtccacccagcccgcatgcgtgcacgcgataacgaatcctttatcagacggaagattctctttattgtatactttgactcctccgcgcagagaaagaatgaatttgatggcatttgcacaaaacttatacataacgcacttcctttgttgtaatgatcaaaagtgttctctctctattataacaatattttttattacctggtactaataaatatatttttcctccgccgatctctatcttttatgacggattttgggtactatagagaaatggtgtttgatgaggtgaaaatgaatttaagccgtttgcatggaacgtgcaactttaaacctttcttatgcgtgtataacatagaggggagaaaaggcagtgacgatcgatgaaatttaccaaatgtatatgaatgatgtttaccggttcctgctctccatgacaaaagacaagcatctcgctgaagatttgctgcaggaaacctttatgagggcatacatacacattcactcctacgaccacagcaaagtaaagccatggctttttcaagtggcgagaaatgcgtttatagattatgtcagaaaacataaaaaggaagtgaccatttccgatgacttaattgggagcctttttcagacggctgttcaaagcccggctcatcagattgaaatcaaggaagtgctgacagggtatatgtccgaacttcccgacaattatcgggaggccttaacactgtattatttaaaagaactgaattacaaagaagcatcccatattatgaatatttcagaggctaattttaaaagtgttttatttcgtgccagacagcggctgaaagcactttataatagaggtgttaatgatgaatgaagaatttaaaaagcgtttttaccaatacaaaaatggagaaatgagcgaccgggaaatggccgcctttgaagaagagctggaaaagcttgaagtctatcaggagttgattgaaagcgaaatgcaggacgaccgggaatgggacgtcggcatcagcccggaaaaacagaaggccattttgtcatacggaaaacgcaaatcgtatttgcggatttcagttctcgccgtcatctccaccttgatgattttgccgctttgcactttgggaagctacctctattacggtttgggaggaaaagaaagcaccggcaatcaattaatggaaaccgcagccgtgacggtggcgaccaccatgccgaacgtactcgtcgatacctccggactgaaaagccaggtgaagctgtttgggatgaatacagagtttccgctgcaaaagcagatcggcacaaaaacgaaatccgtcggcggagaacggattgaaatgtttttagatacggtcaaatcgcctgccgttaactactatgatctagacgcggcacaggcaaagcattattttgcccatccttccggcttaaaggaacgcacgattgacaaagccggacagacattaaaaaaattgcctgaaggaagcgtggcggaggtctatctttcttatgaccgggcctatccttcttctcaagtatattctacttttaaaaaatacgatgtgaagtttttatggaacgcggtcgaaacggagaaaaatctgaaagacagtccttatgccgagccgttaggatttcccgggaaagattccaagatggtgtcctctttcgaaacgcaaggacagacagaccgtgaacaatttatcaatgcccttgaatttatgtcccgccataaaaaatgggcgcatgcaatatcgaaacgcaaagacatgaatcttggcagccgaatcgactatgttgaacatcacggaatgaacgtatacggctctgtcgtgacggggccgacaaaagaaatcgaacgtctgctgaaaaataaaacagtaaaagcagcaaacatcggtgaggtggaattatggaattggtaagaatttttaaagagcataatgttttcggctggatatcagtcggtaccgcgattttgtcgctgctgcttttgaacgtggcaatcatcagcaatgtgactttctattcttatcagatgctgccgtttgcgatggccgccgtgccgttcggcatcattgagctgtttattaaaaaaggacggacgggcccgggactgctcggtgtcatcctcaaccttttcgtcattgtttgtgtatatacgatcgttgccgttgatacgaatctgcaattcggtttttaaacataaaaacaggcccttttacaggggcctgtttttttaaaatgaaagaacgccgattaaatgcagcaatacgacgatgatagccagcggcacgaggtatttcagaaggaaataccacacctgaaagaaacgatagccgatggcggaaccgcttttcatctcggcgaacagctcccgcttcggtattttcagcgggatgaagattgatattaataaagcgccgagcggaatcagcacattgctcactgtgaaatccgctagatcaaaaaacgtttttccgaacaaatgaacatcaccgagcacaccgtatgataaacacgacggaattccgactaagaaaatgagcagaccgcttgtccacgacagcttcttccttttcgtttcatcacctttcccgacagtcgctacgataatttccaccatcgaaaaggccgaagtcagcgcggcaaagaaaaagaccgccagaaagctgataaaaaacagcgagccgaacggcagccggtcaaacacagccggcagtacggtaaacagcagtgtaggcccttcatccggtttaaatccgaacgaaaaaaccgccggaaaaatggccagtcccgcaaacagcgtgacgagcacattcatcacaacaatggaacccgccgatcccggaaggttttgggttttcggcagatacgaactgtatgtcaccatgaccgaaacgccgagcgttaatgtaaagaacgcctgtcctaaagcatataggatggattccggcgtcaaatcttcaaagtgcggaaccaataaaaatctaatcccctcaacggcatgatcgagcgtgactgatcgcagcaccagcaatagaaacagcacgaataaaaccggcatcagcaccgcactgacacgttcaatccctttctgcacgccttttgcgacgaccgccactgtcaagatcataaatacaagctgcgcggcgagagtctggatcggattttcaatgaccgtcccgaacaccgttccgtactgctcctgagtgagcccggataaagaacccgtaacagcttttaacacataaagcaaaatccacccgccgacaacactgtaaaaagacaaaactaaaaaacaggccgccacacccacataacccgtgaggtgccataccgacttcggcgcggcttgtttgtaggcatcaatcgcatttgtctggctccgtcttccgaaaataaattcaccgagcaaaagcggatagcctaaaagcacggtaaagaggacgaatacaagaaaaaaagcgcctcctccgttcgtacccgctacgtaagggaacttccaaatggctcccaggccgatcgccgaaccggcagcggccataataaatcctatttttgaggcccattgaacccttttttggtcagacacgactttccacttcccttccgccctatattatcccttattcactgcgataacttaagcccatttcaatatgtttcattattccgaaaaataaaaaggagcggcgggtgccgctccttacaaatccccgtttaatttcgaatgctttctcgaatataagaaataaatcaccagaccgatgatcagccagataaagaaacggaatatggtggtggcgccaaggttaataatcaaaaatacgcagaacagaatggacaatatcggaataaagggaacccccggacatttaaaagctctcggcagatcaggctgtttctttctcaatacgataaccgccactgaaatcaggacaaacgcggcaagcgtgccgatgttcaccagcttcgccagctcatcaagcgggacgagcgagccgagtaatgccgacaggatgccgaacacccatgtcaccacgtgcggcgttttatgcttcggatggacttttgaaagcgcccccggcaccaaaccgtcacgggacatggcaaacatcaccctcgtctggccgtacagcatgacgagcatcaccgttgtcattcccaacactgcaccgatatcaataatcccggccacccaattctgtccggccatctgcaggacgagagacacgggatggtcaacgccttcaaagcgggcaaacggaacgacgcccgtcataatcgccgatacggtcacatacagcacggtgcagacgattaatgaaaagataattcctttcggcagatccttcgccggatttttcgtttcttcagcggcggaagagacggcgtcaaaaccgataaaagagaagaaaacgagcgccgcggcactgaaaacaccgccgaaccccatcggtataaacggctgccagttgtgaggtttgacatatacggccgcaacggcgataaacaatagaacaaccagaaccttcaaaatgaccataatattattgacccgcttcgattccttaatgcctaagtagaggaggaatgtaatcgcaagcacgataacaaatgcggggagattaaagaatgtgaccgtgcctttaatggatcccggcgcggccgttaatgcggtcggaagatgaatgccgaagcccgccaagaatgattgaaaatagccggaccagccgaccgaaaccgcgctgacggcgagcatatattccaagattaaatcccatccgatgataaatgcgagaagttcacccagtgtcgcataagtaaacgtgtagacggaaccggaaaccgggacgcttgaagcaaattcggcatatgacaaagccgcaaataaacacgcaagagcggcgatgacaaatgaaacggtcagccccggccccgccgtgacagcgcctgttccggttaatacaaaaattcccgttccgatgatggcccctatccccagaagtgtcaaatcaaaggcccctaactctcttttcagcgacttttccccgcccgttgcggcaagcaggtcctgaatgcttttctttctgaatatgctccccttcatctgcttcactccttgtaaatcaatatatgttagaatattcagacaacaatagcaataatgactaaattcttatttttcgcatgaaatgtttcagcacatcattcctttctcctacaccatattatagcgaaaaatataaaaatgaaaataacttttttgaaaattctatatattatttcagttttcataaaacagaactcagcggattctccgctgttaaatattaacattagtaattcagctggcggcttctattttttaaaaatcgtattcatatgtaatcaaataaaaatcccgccctttttaaaagcgcgggataagacttgcttattatgttgaaataaacctgcctccatttacgtgaatggtctgcccagtcatataggaagattcgtctgaagccagaagcacataagctcctgcgtgttccgcaggctgtcctggtcttcccatcggagtgtccagaccgtgcttttccaccttttcttcagtaaacgttgccggaatcagggcggtccagatcggcccgggtgccaccgcatttactctgatcccctgatcggccaatgacatcgccattgaacgcgtaaaggaaacgatgccgcctttcgtgcacgaatagtcgatcaatgatgtgtctccctgataagcggtaatcgacgttgtattaatgatggcgctccctcttttgagatgaggcagcacggcttttgtcatatgaaacatggaaaacatgtttgtacggaatgtcttctccagctgttcagccgtaatatcaagaatcccgttttgcggatgctgctcagccgcattattaacgagaatatctatttttccgtagtgatctaagacttgctggaccgccttctgacaatgcgcctcatcaccgacgtctcccggaattaacaggcaatcggcctggtattctctcgcacgctttttcgttctctcggcatcggcatgttcgtctaggtacaggatggcaagatccgccccttccttcgcgtaagcgatcgcagccgctgcgccgatgccgctgtctccgcccgtaataacggcgacttttccttttaatctgcccgacccttttacatccggatcctccaagagcggttttggctccatgtctgactcaatgccgggctggcggttttgcacctgcggcttttgtccttccgtctgtctgtccatcggattcatattctcacactcctgcaattggtattactgagacgataccacgcagtgcggggagttaaacggacaaatatgccggtaattaaagctgctgagccgtttcgggaaaagcgccggtgtatttcgcagacggtctgtaaatcatgttgtcagcggactgttcaagcacatgtgcgcaccagcctgccattctgcttgctgaaaaggtcggcgtaaataaatcattgtcgacatcaatggcctgcatcacagccgctgcgtaaaactccacattcgtatacagcttccgtccgggcttatattgctctaacaagcggatggcttccttctccacataaagcgccaagtcaagcgacggatcatttcccgccacttcttcagcctttatgcgcagcgcttccgcccgcgggtctttcgttttgtacaccctgtgcccgaagcccatcaggcgttctcccctcataagcttcgctgtcaaatacgcttctgcattttctttttccccgatgtcttcaagcattttcgtgacgcctgaaggcgcgcctccgtgcagcggccctttcatcgtacccagtgcggcagtgacggcagacactaagtccgattcagtcgaaaccgtgactctcgctgaaaaagtcgatgcattcatcccgtgttccatcgccagaatcatatacgtctcaagcgctttcttttgggctgcggacggctgcctgcctgtcagcatatacaaatagttttcaacgtgtccgtatcgcgcctcgggtgacagcgcttcctgcccttgtttacggcggtatctgtacgcaataatcgtcggtgtgacggcaatcagtttaatcgcttcttccggcttgggcggatatgtaaatgaatctgtgcccaaacctgaaacagccgttctcagcaccgccatgtcgtccatttcatccggaagcgtttccagtaagccgatcaaatgtttcggaagcccgcgctcggctgcaagttcttcctgaaacgcaagcaattgccgctcatcaggaagcgccccgttcaaaatgagatacgccgcttcttcaaaactgaattgcaatgcgatatccttcgcgtcatagccgcgatatattaaatgccccttttctccgtcaatgtggctgatcgccgtttctgcacaagtaatccctttcaatccacgataaatcaatttcattcccccttatcctctttctgttattatagtaaatataatatttaaaaaataatgaatatttttaagggaattaattaaaacttttaatcagaggagtgcatctatggattttaaatggcttcacaccttcgtcaccgcggcaaaatacgagaatttcagaaaaacggcggaaacgctttttttatctcagccgaccgtcaccgttcatataaaattattagagaaagaaatcagctgcaagctgtttcagcggagcggccggaaaatacaattgacggaagaaggaaaagcatacgtgccgtttgccatgagacttttggaagactatgaaaacagcatggcggagctgcacagggtgcgccagggctactcgcacacgctgacactcgctgtttcgccgcttatcgccgacaccgttctcccgtctgtcatgaagcgttatacagaggacaataaagaaaccgaaatgacggtcaccattttcgaatcggaagaaatcgcctctcaaatcagaaacggctcagccgatatcggactgagctgcttaaaggtgcaatcatcttccctcacttgcctccccctgtacaatgaccccgttgtcctcgtcgcgccacccggccgaaaacccgggacagggaaggcggatgaagtgaaagacctgttcggacaatatctgcttttgacccataaccatcctgactattgggatgatttgctccgccaggtcagaatacagttccctttcgtcaggacaatgaaggtgacacagacgcatattacgaaacgatttattaaagaggggctgggcgtctcatttctgccgctgtcagcggtacggtccgaactcgccgcaggcagcatgattgaaattccgtgcgaattcgcccagatgccgagcgcgggcgcgtacgccatcgccctctatgaaaatgaaaaaaagaaaacctttttagattttttatcacattttcatttttaggtgaaacaaatggagctctgccccgtctaaataaaaaacccgttcggatgaacgggtttctctcactgctagaatcttttcgcgcccaggtagcgcggtttccagtagctgttattcagatcacttgttgtgacgccgtcagaaccggcatggatgaacttgttgtttccgatgtatacacccatgtgtgaaggaccggcttgatatgttgtaaagaagacgaagtctcctcttgacgggctggatacgctcttcattgagctccagtatcccgcagtgcttgttctgccgacactcgtctgtttgtttaacaggtaccagataaatccgctgcagtcaaagccggaagtcgttgttccgccccatacatacggcgtgccgattaaagattgcgcatcagaaaccagcttgtttacattcaggctcgtctgtgcaatattatggctggatgaaggcttctttgatgacgaagatcctgaagacgctgaaccggaagttgatccttttactttaagcacttgtccgatgcggatcaggtccgtttttaaaccgtttaaactttttaattggtttaccgtcattttatatttattcgcaattttccaaaggctgtcgccttttacgactttatatgtagacgatgatgacttgctgcccgaatttgaacctgaagatgatttaccgttgatcgaaagcgtctgaccgatgtaaatgatatccgattttaatttgttctcagatttaatggaattaattgacgttccataccgatttgaaagtccccataatgtatcgcctttttttaccttaatcgtttgcgcagacgccgcgcccgcaaacaaagtcgtccccaaaaccactgccgttgttgctgtaacaagttgctttttcatattttcctccctgaatgattctatctattttatgtgtctcttttttaaagtttttatctgtttcctattataaggttcaatttccactagaaatagacttgacttcccgtgacaaatttcttactaattcgtttttgaaaaaagtttttaagggtattaaatatttcaatttgatttcaaacgtgacgaaaaacgagtcaatttgtcatgtttttttcctgtgatcctcgtattttggaaaaacaaagcagtttactttccaaataactccttgttaaaaaaatcctcgtctttttcaaaaaagtgaatggttttcactctttcttgaaaacataagttacaccggaatttacatttctaacaatgtttcacctgaaatttacaggaggaacaggcgctctttacaaacaccccctaccattagacatgcagacacgattaaaggaggacgagtgagaatgagtctatttaaacaggttcgatcaaaacttctgccggcggcagccgtatccgtgctgacagccggtctgattgcgggcgcggggtttcagcactctgaacaggctgcggcaaaaaaacagcctgacaaaaacgagatcagaaacgtcatcttcatggtcggcgacggaatgggcgcaccctatatgaacgcctaccgttcggtcattaacaaaggaaagccttcggatggtatgaaactgacggcattcgaccccaatctcgccggtatgatgatgacttatcctgacgatcctgattccaatattaccgattccgcggcggctggcacggcaatggccacgggcgtgaaaacgtataacgcggcgatcggagtcgataaaaaaggaaagcgggtcaaatccgtcctcgaagaagcgaaacaaagagggaaatccaccggacttgtcgcaacttcggagattgcccacgccacccctgcggcattcggagcccataacaaatcccgaaagaacatggatgagatcgcaagcagctactttgatgaccgcatcaacggaaaacaaaaagtcgatgtgctcctcggaggcggcaaatcaaactttatccgtaaagaccgcaatgtaacaaaggatttcaaaaaagcgggatacagctacgtgacatcaaaacaggagctgaaaaaggaccgtaacaagaagattctcggcctgtttgccgatggcggactcgacaaagcaatcgaccggtcaaacgctgtcccttcattagaagacatgacaacggcggcgatcgacaggctgaacaaaaataaaaaagggttcttcttaatggtcgaaggaagccaaatagactgggcgggacatgacaatgatatagtcggcgcaatgagtgaaatgaaggattttgaaaaagcgtataaagcagcgatcgcatttgccaaaaaggacaaacatacgcttgtcgttgccacggctgatcataccaccggcggattgacgatcggcgcgaatgacgataaaaactggcatgttgaaccgattcttgccgccaaaaaaaccccggcatttatggctgaccaaatcaaagcgggcaaatccgtatcttccgtgcttgcgcgttatacagacctgaaatggtcaaaagcggaaattaaacagatcgaaacggccgcaaaacaggatgctgacaagagcgtctacaaagcgatcattaagctttttaatgcgaaaacaaacagcggctggacaaccggcgatcatacgggcgaagaagttcccgtttacgcatacggtccgggaagagagtcatttacggggcttttaaacaacacggaccaggccaaaaagatctttcacatcctgaaacacggaaaataaaaaaggatgcggggatttccccgcatcctttcttcttttacaaatatctccggtgcactcctttgccgtcatacgaaaacatcacttctctgtcttcaagaacagattcgatgtgcacgctcctgccccacagctggtacagatacggcagcactttctccaaatatttcagatcaagctcaattccctcataccaatgtttaatataaagctcattattcttcaggtaatccccgtcattgacggtcagataaggaaatcccccgttgacccgcatgttcacgagctggtcgcgcacggccttccattctttgtcgatcactttatagtccctgccctgcttttggaataaatacaaatcctcacgcataacgagatctttcgtcaaataattgcggataaatgatatgtccgattcaatttccctgacctcaaacattttctcgcggccggaaccgggctttacccctgtttttttcatttcatctgtcgggttgtcataacgctcttcgatgtcttcaaaaattttcagccctaaataatacgggttgattcccgtttttgacggctgaacgacgcctgcgttcagcttcgcaaattcgatggcttcatctgaagtcaggtcaagctcgcggataatccgctgatgccaataggatgcccagccttcgttcatgattttcgtttccagctgaggccagaaatacagcatttcttctctcatcatggttaaaatgtcacgctgccacggttcaagctcccgcgaatgttcctcgataaacagcagaatatctttttccggacggggcggaaacggttttttccctcttttctttttcacctgtttcggcttatccattccccataaatcatcgtaaggcgatggcgcggtttcttcttcgtcctcctcttcgtcatcgacgctccacagcagcttcggcctgacgagcgacggatcgatatgctcctgaatcgccagaatggcatctaaaaaggactccacctcttttatcccgtgaattctttcataatgcttaatccgctccgccgcagccgccatactctcaaccatgtcccggttcgtattttgaaagcggcagttatttttgaaaaaatcacaatgggcaagaacatgggctacaattaatttattttggatcagcgaattgctgtccagcaaaaaagcgtagcaagggttggaattaatgacaagttcataaattttgctcaaaccgagatcataatggagtttcatcttatgaaattgtttgccgaaactccagtggctgaatctcgtcggcatgccgtacgcgccgaatgtataaataatttcagccgggcaaatttcatatctcatcgggtagaaatcaaggccgaaaccctttgcaatgtcggttatttcctcaattgcccgctgtaaaccttttgtctcctccgcgttcaagcgaatcccccctacttggacttatttataatgtatgacccctcctctcaaaagatgaaataacagaccggtttccgactgaaaactttcggcacatccgccctgtttgctttatatgtaagtgggtaaaacacacaccataccccaaaaagaaaaggagcgattctacttgaatacagcagacatgcttacgacgtatctcagcaaactcccgaatctgatcattgcactgctcgtcctgcttatcggctggggcattgccaaaatcattgaaaaagccgtatacaaaggcctgcaaaaaacaaaaatcgacgacaggctgttcgccgaaaaaaagccggcgcgctattcctcagaaaaagtcatcagtaaagtcatttattttatcgcattaatcatcgtttttattctattctttaacattctgcatctgacaaccgtggcttcgccttttgtcagcatgctgtcggcgataacggcggctgtgccgagcgttttaaaagccggcttgattctgctcgtgggctgggcggccgcttcgcttttcagctatctcgtcaaaaaagcgggcatgaaactcgctgaaaacggccggctcagaaaatggacaatggtgtctgaagaagcggagatgagcagatccgttacggccgcttcacgaatcgttttttacttcgtcttgctcttgttcctgcccggcgtcttgtccgctctccagatcagcggagtgtcagggccgtttacaaatatgattcaaagcgttttgtcctttataccgaaattattcgccgcggcgctgattgttttaatcggctggcttgttgcccgtctcgtccgtgatatcgtcacaaactttctggcgagtatcggaacggaaaggctcgccgcacgtatggggctttctatttatctgaaggatacgagcctgtcggcaatcatcggaacgattgtctacgtgctgattttcattccggtgatcatctctgcgcttgaccggcttgatgtggcgggtatttctgaaccggcgtcagccatgctgcacacggtcttcacaatgctccctaatatcatcatcggtattgtgctgatcatcgccggcatctgggtcggaaaatgggtcagcagcattgtatccgggctcctgcaccgggccggtttcgactctcttctcggtaaaatgggctttgaacaggcgggcaccccgaagctgacgctttctcagacggtcggcatgattgttcagatcatcatcgtcctgctctttacggcagaggcgctgcagcttgttcatctcgaatttctcgtcgttatcgcaaccggtattatcgcttacctgcctaatgttctggccgctgtatttattctcggaatcggacttttggccggacagcttgtcagcaggctgcttgccggcatgctgagcggaaaggaattcagattcctggcgccgcttgcgaaatataccattatcactctctcaatctttatggcgctggatcagctcggtgtcgccgacacgatcgtaaatgccgcgtttattctgattctgggcggtttcgcgcttgccttcggactttcattcggtcttggcggaaaagaatttgcctcccgttatctcgcaaaattggatcgcaaaattgaaaaacatcaatcggctgacgatcgtaagccgccgatgtcttaacgaaaaaaacgtgtgctcagaaggagcgcacgttttttttgagttaagggggcaaattccttttttttcattttagattcatatatgatagactgtaacagaagcaaaatctcttttttcgaggtcattctatgaaattaacgaactataccgattactctttacgcgttttgatttttttggcttccagacattccgacgaactttccaacataaaagaaatcgcagatacttattccatctctaaaaaccacctcatgaaagtcatttaccgtctcggccagctcggatatgtcgaaacgatccggggccggggaggcggaattcgattaggaatgacaccggaagacataaacattggagaagtcgttcgacatacagaagacgactttaacatcgtagaatgctttgactccaaaaaaaatctctgtatcatatctcccgcctgcaacttaaagaaccttctgaatgaagccctgcaagcttacctggccgttttagacaaatatacgttaagggatctggtcaaaaacaaagaggagattatgagactgctcagaagctgaaggaatgtccgcattccttctttttttatgccggcataagaaaaaaggactatttctattaatatgataaacgattgcagacaagtgccgatataaagattatcattactgatatcctcaccttgcggctgcaacgaatggggatagaaaaattatcgcaggaaaagggagattcactatgaaaaaaaaggtagcggtcggtttgactgcatctgcgatcgtcgggtctgcgttagctgtaacaccggcagaagcacaaacgattaaggtcaaaagcggagattcattatggaagcttgcccaaaactacaatacaagcgtggatgccattacatcagcgaatcatctaaaatccaccgttctttctatcgggcagacgctcaacattcctaacggcaaatcagattccggcagcaaaaagccatcttcaaagaacagcggcacgactaaaagcgtctatacagtgaaaagcggagactcgctgtggctgatcgcatctgattttaaaatgtccgtacaggaactgaaaaaattgaacggtctgacaagcgacttaatccgcgccggacagaagctgcaagtgacggggaaagtttcctcaagcaccgatcagaaaaaaaccgctcctggcagcagctcaaacagcagcaaaaagcagtcatcatcttccgggacctataaagtaaaactcggcgattcactatggaaaatcgcaaacagcgtcaatatgaccattgcggaactcaaagtattaaacaacttaaaaacggatacgatctacgtaaaccaagtcctgaaaacaaaaggaacgtcttcttcgggaaacacgccgtcaaaagacaattcaaaccaaaatcaaaaccagacgcaaacgtcctcctatacagtaaaaagcggagactcactctggaaaatcgcaaacgcatacaatatgacggttcagcaaatcagaagcatcaacaaactgacgtcagacatgctgcgggtcggacaagtgctgaagctgaccaaaacgtcttcttccggctcttcgtcttcaccgtcagctccgaaccagtccggaaatacagggaaaaccactacatataccgtgaaaagcggggattctttatgggtgatcgcccaaaagttcaatgtgacagcccagcagatccgcgagaaaaacaatctgaaaacagatgttcttcaaatcggacagaaactgacgattaccgggcagcagacaaacacgacaccgaatcagtccggcagcacaggcggcacaggttcaacaagcgcgaagattaatgtaatgatcgatgccgcaaaagctcagctgggcgtaccgtatgtatggggcggaacgacgccgagaggctttgactgcagcggtttcatttattacgttctcaataaggtcacttctgtatccagactttcagccgcaggctactggaatacaatgacatcagtcagccagccggcggtcggtgactttgtctttttctcaacttataaagccggaccttcccacgtcggtatttatctcgggaacggccagtttattaatgccaacgattcgggagtcgttatttccagcatgaacaattcctattggaaacagcgctacctcggcgcaaaacgtttcttctgatacctgataagctgtacggccgcataaggctgtgcagcttttttacagtctgaaaatattgatgctgatcacgtgttttgttacgggatggaaatacacttcagcacgggatgaaaacgtttcttttgcggtttgcaccgttacgcgaaacacgtctttcgtctgttcccggttcacttttgtacggcccatgtacgaataatcggtaagctcggcccccttgtattcacgttcaagctggttccatgcgagctgttcccatttttcaactgacggatcgaggtgttctgtatgccctttttcagcgatagaggcaatgagaatgccgcaaaacaagagggcaagcgcaaatggaagggatttcatctttatgttctcctgagtcgttttttgtcaatcttagcgtgtccaaagaagagacggatatgcggttttattttatgtctccctcatattgctatgccgcagtgataaggacaccaagttttcccccgttgcatccgggcttcggcggcataaactaacggagaacttctcattgaaaggagaagcgtaagatggatcatgccgattatgataaagccttgtattacacacaccggtctcaatgggacaatttattaattttgatggttcgtacaaaagatgatttattatcaaagcgtattgagcactttctacacgcgtatcatttcgaatatgatcatgccgtgcttgaaaaagagctgtattcccttctcgggtatattgatcatgcgacagagctcgcttatgaagatcaattagccatgctgacataaaacaatcccggcgtcagacgccgggatttcttgtgtttgtgaacatattcagctcttcgatcatgtctttcaggctgaccgccatatcctcagatacggtccggcgctccatgtcgatgtgaatcgggtctaagaccagctgtttcgggatgacatttgcatagacgccccgcatgaccgtccgcatattcgccagcgcattcatgcctccttttcctccgcccgccgcggcaatgacggccaccggtttgtatgcccagtgatcgctgcttaaaaaatcgatggcgttttttaaagcgccgctcatgccgctgtgatactcgggagataataagacgacggccgctgactttttcacctgccgccttaacttttgcactgaaggcagctcgttctgttcttcttcaccgttataaagcggcagttcactttcgctcaaatcaataaaatcggtatgaaaccgatctctgatataagaagcggcaattctcgtccgcccgttttttctcggtgtgccgctgatcactaatatgctcatgattttaccgcctttcccaaaacattatattttaccgcatacaatgccgcctgcgtccgatcggaaagattcagctttgacagcaggttggacacgtgggtcttcactgttttttctgaaataaacagggccgccgcaatttccttattgctttttcctttggctatttcttgaagaacatctttttcacgggggatcagctgataatatttttccttatcctgatcatcctgaaccatatgggtcagcacgtgaggcacaatatccgaacttccggccgccgtcctcaagcggtacggtcgcatgatgggtaatgccctccgtatcgcggcagttcgtcgtctgttccgcaaattcaatccgtttgcaattcattatgtttacggcctttgtcaatccgccattgctgaatttggtcagacaatagcattccccgctgcacatgagtgcattttcccgctgaccgagagcaggcggtaaataagcggatgcggcgagcgtataagacccgtccggctcaatcagaaaaatccaccctgtctgcagtccggtcaggctgagcagttcgcggagcactttatcaagcgcttcctttaaatcgtggttttggtttaaggtttccgcaatcgcttttaacgtttttaacgtttctaccgtcgttttcgtcaatttccctcactccggccaatcagaattatccatattatatcaattcttttctgtatattcctttgttttcagcatgaattttcctcatactttcggatgaggcgtataaaaaaaccgccggatgtcgcttccggcggtttgttgtttatttcgttttttccactatgccatccaccgttttcatgacggcttcagataatgcggcaagacgctgttcgctgtcttgtaaagaagtccccttcacggcgaaatagaacttcactttcggctccgttcctgatgggcgaaggcagaaccaagagccgtcttcaaggaaatatttcaggacatttgacttcggcagatcaatatcttcttcaagatgatcggcaaatacagtccgttttcccgttgaatagtcttcagcctgcgtgatttgttttccggccatctgcttcggcggatcgtttcggaatgaagtcaggatagcggaaatctgctctgctccctgtttcccttttaacgtcaatgacttcaagccttcacggtaatatccgtattctttaaaaatggacagcagcgcgtcataaagcgacatgccctgctttttataaaaggcgcatacctcgacggctaacagcgcagcctggatcgcgtctttgtcacgcgcgaaatcgccgattaagtagccgtagctttcttcatacccgaactggaacgtgtattggcctgatttttcatattctttgatcttttcaccgataaatttgaagcctgtcagcgtgtcaaccgtatctaatccgaacgatgaagcgacagcgcggcccaattcgctcgtgacaatcgttttcatgacgacaccgttttcaggaagggtgccctgttttttcttctcggaaagcaggtaatgcaataaaagcgcgcctgtctggtttcccgtcagcactgtgtacttgccttcgctgttttttacggcaatgccgagacggtcggcatccgggtccgtagcgacgagaatatcggcattttgttcttctccgagcttaatggcatattcgaatgccgcgtgctcttccggattcggcgatttgacggttgaaaaatccgggtccggcagctcttgctcctttacgacggtgacgtttttgtaaccgagtgcttcaagaccgcggcgcaccggtttatttgccgtgccgtgcagcggagtgaacacgacgctgacatccacttcatccgaaagctcgggatgtacggagatggaagtcagtttttcagtatacggtttatcaatttcttcaccgattattttaatcaaacctttttctttcagcgactgttcatcttcaacttgaatcgttaattcattttctatggcattcacttccgcaatgacgatgtccgcttctttcggcggcagctgtgcgccgtcatcgccatacactttatatccgttatattcaggcgggttatggctggccgtcacgacgatgccggcataagcgttcagctttctcaccgcaaaagacagctcaggcgtcgggcggagctcatcaaagacgtatgtttgaatgccttgggaagcaagggtttttgcagcttccatcgcaaactcaggagatttatgacgggagtcgtatgcgatcgcaacccctctttttttcgcgtcttccccctgtttcgcgatatacgccgcaagtccggcggatgctttgcggaccgtgtaaatgttcattctgttcgtacccggcccgatttctcctctcatgcctcctgttccgaactcaagatttttgtagaaaaaatcttccagcagctgctcgtttccttctgcgtccgccaataattttttcaattctgaatctaattgttcggcctgattccagcgttcgtaactcttactccaactcatgttcgtcctcctataatttcagcttatgaccatattttaatatgaagcggctgcccgtgtcacttgataacttaaccaaatgctttatgtaaaaagataaaagaagggctcatgccttttcggcacagccctccggttattattgttcgagcggaacaaccgcgtcgtgcagcagcgtatttaaccactcagtgtgtttttctttcgtttcgtcattccattggaatcggtcgctcatgtaatcaatcacggccgttttatacgtttgcacccatttgatgtcgaagaacagtcttcccgttctgcggacgaagaaatcggcaggtgtcgcagccatttcttcttcgatgctgtaagccgcttccgccagaatgtgaaccggaatctcgcgtttttccgcttcatctttcaggccttcaatccggctgaatacattttcaacgttagagccgtatctgatggctaactgcttagcggtttcctgtgataaaccgattttcaagccgtcttttgtctttgcttccacaaatgactcgaagtttttagagccgccgacatgtccgccggaaatcggcatcgtcttcgtcttgcagccgccgaagtcctggccgccctcttctttcaagcggtcgcggacaagatcgacaatgtgctcagccattttacggtagcccgtcagttttcctccggcgatcgtaatcaggcctgattgagatgtccagatttcatctttacgggagatctcagacgggtctttcccttcttcgtgaataagcggtctgaggccggcccagcttgattcaatatcgtccgccgtaatgttcagttccgggaacatataattgatggagctgacgacataatcgcgatcctgcaccgtcatgcgcgggtgctcaagtttttgtttgtaaaccgtatcggtcgtacccacgtatgtttttccttcacgcggaatggcgaacaccatccggccgtccggcgtatcaaagtacaccgcctgtttaagcgggaatacggattggtcgaatacgagatggaccccttttgtgtgctggagatgttttccgcttttgctgtggtctttttctctcagttcgtcgacccacggacctgtcgcattgacgatttttttggcgtacactttgtattccttgcctgacagcagatcttcaattaaaacgccgacaacttttcctttttcataaagcagttctttcactttagaatagttgacaggctcagcaccgaatttaacggcttctttcatgacttcaatcgtcagtctcgcatcgtccgtccggtactctacataatagcctccgccttttaagccgtcttttttgacgagcggctctttttgcagcgtttctttagcagacagcatgcttctgcgctctgatttttttactcccgctaaatagtcatacacacgcaggccgattgaagtagagaatgaaccgaacgtgccgcctttatgaaacggcagcagcatccattccggcgtcgtgacgtgcgggccgttttcgtacacgatggcgcgttccttaccgacttcagccaccattttgacttcaaattgcttcagataacgcaaaccgccgtggacaagctttgtggatcggcttgatgtgccggccgcgaaatcctgcatttcgctcaaagcgactttcattccccttgaagcagcgtcaagcgccgtaccggcacccgtaatacctccgcctataataaacagatcgtatgtttttttagtcatgtcttccagcatatgatcccgttccaaacttgaaaattggtgattcatcattacgcttcctccttgttgtcacggtatagaaaaagagaccacaacagccaaagcgcatgtcatcactttggtgctgtggtctctcctcatctcaggaccgttcctattaacttgttttcagtataccataattttatcttatttaaaagccatagctgcatttactgcttttttccatccgccgtacaattcaacgcgtttttcatcttccatttccggtttgaattgcttatcaaggttccactgatcggcgatttcagtgctgtccttccagtagccgacagcgattccggctaaatacgcggcaccgagcgcagtcgtttcattaatttccggacgttcgaccggcacatcaagcaagtcgctctggaactgcatgaggaagttattttttaccgctccgccgtctacacgcaatgtttttaaagagatgcctgaatcagcctccatggcatcaagcacatctttcgcctgatatgcgagagattcaagcgtggcacggataaaatgctccttcgtcgttccgcgtgtcaggccgaaaactgagccgcgcacgtcactgtcccagtacggtgtgcccaatccgacgaaagcgggcacgacataaacaccgtcagcggaatccacacgctctgcgtatgtctcgctttctttcgaatcctggaacatccgcatgccgtctctcagccattggatggcagaacctgcgacaaagatgcttccttccagcgcatactcgacttttccgtctaatccccaggcgattgtcgtcagaaggccgtgatcagaagtgatggctttttctccggtattcatcagcataaagcagcctgtgccgtatgtgtttttccccatgccttcttcaaagcacgcctgaccgaacagcgcagactgctggtctccggccgctcccgcaatcggaatatttttaccgaagaaatgataatcaaccgttttcgcgtacacatgagaagacggtttcacttccggcagcatggatttcggcacgcctaaaatatcaagcagctcgtcatcccattttaattcatgaatattaaacatcagcgttcttgaagcgttggaataatccgttacgtgcgccgcgcctccggacattttccagatgagccatgaatcaatcgttccgaacagaagatttccgttttccgctttttcccgcgcgccttctacattgtcaagaatccatttgactttcgttcctgagaaataagggtcgatcaaaagtcccgttttttctctgaatgtatcattatatcctttttcacgaagctcttcgcaaatgccggatgtttgtctcgattgccacacaatcgcattgtataccggctttccggtatctttatcccatacgaccgtcgtttccctttggttcgtgatgccgatgccggcaatttgatcagcgctgattccggactcggaaatcacagtcgcgataacggcgagcaccgatccccagatttcgttcgcattgtgctccacccagcccggctgagggaaatgctgtgtgaattccttttgagcggaatgcacgatttttccttctttattaaaaagaatcgctcttgaacttgttgtgccttggtcaattgataaaatataggtctccatgatgccgctctcctttttaaatatattcagaatttgataatgttttctgtgattgagatttcttggtataaatatagagtatgaaaagcactacaaccattataacgcttacaaaccaaaagctaggtgtcacatttcctttaaacgcggcattgtaaaatacgccgccgaacgcaccgcccatgatcggaccgattacgggaatccaggcatatttccaatttgacggcccttttttcgggatcggcagaaaggcgtgagcgattctcggccccaaatcccgcgcagggttgatcgcatatccggtcgtccctccaagagaaatcccgatggcaacgatgaggaatccgacaatcagcgggttcagcccttttgtaaattcattcgctccgattgccaaaatgccgagcacaagcacaaacgtaccaatgacttcacttatcatattcccaaatgtatggggaatactcgggccggtcgagaaaacgcccagtttagcggccggatcatccgtcgccttccaatgcggcagataatgaaggtacacaacaaccgcaccgatcattgctccgatcatctgtcccgcaatataaacagggacgtctttccaaggaaagctgccttcaagcgcaaggcctatcgttaaagccggattcaagtgagcgccgctgatgctgccgacggcatatgccgccatggctactcccaatccccagccgaatacaataacaatccatccggattggtatgaaagcgatttctttaagttgactcccgcacaaacgccgccgccgaaaataacaagcagcattgtaccgattacttctccccaaaatgctgtcatcatcattcctcctaaatgacaaaatagcaggtttgacagagttatagagaataaaaaacccacaacaaaccgctttacgctttattgcttccgtaaagagctgttgtgggtctccgggtctccatcacatagtattaacctaggtctattgtaacaatgggtgtaagcggtgtcaatctttttttgtcatagaatgttcatatttagcccatagttcggtgtctgaagtcgtcacggccgtggctcctgcctgcaaggcgttttcaacgtcctgctccgtgcggatgaagccgccggcaaaaatcggaatccccgtcatttctttaatttctctgattaaagtcggaacgatgcccgggagaacctcgataaagtcaggcttatgctttccgacgaattccatgcttttttccatggcgctcgtatccaagagaaacagacgctggatcgcgtatattttcttttgtttcgctttgacgatgacggcggatctcgtcgaaatgatgcccgcgggccggatgtcctgacaaatgaactccgcaccgtattcgtcatgcttaatgccgtgaattaaatcgacgtgaaccatcagaagttttccgtgttttttcgcttcattcacgacaccttttaattgaccgaggtgtatatctaaaatgacgccgtataagaacggactctctaaaaatgcatcgaattgcttcatgttccggatagccggtagaatcttctggttgtgaaaactcatgttttactcctttactttaaaaatcaatgctcagcacgctttccttgacggtcgaaatgatgaaagagagctcctcgtcggacaggcaaaaaggcggtgacagctgaatgacattattatatcccgctacagtatcaccatttttcccgacaagcaggcctttttctctgcacgcggtgatgacgtgctgcacaagagcggcatcagcgggttccttcgtgattttgtccttgacgagctcaatgccggcaagaaggcctttgccccgtacatcgccgaccgccggatgttctttgagcggctcaagctcacggagcagccgttctccaagctcccgggagcgggcgatcagattttcgtcctccatcaattgcaggtttttcaaagcaagggcgcaggctgccggattgcctccgaatgtattcacgtgccggaagcggccgtacggctcaccgcccgaatacgcctcaaaaatctcccgttttactgccgttgccgacagcggcagataagcgctcgtaatgccttttgccattgtgacgatgtccggtgaaacgccgtaatgctgaaatccgaacggctctcccgtgcggccgaaaccgcaaatgacttcatcactgatcagaagcgcgccgtggcggcggcaaatgtcctctacctttgccatatacccgtccgggggcatcagtatccctccgcctgtaataatcggttccataataacgccggcaatcgtttcgcttaactcccacgtcatgatccggtcgatttcatgcgcgctttccaatgtgacggcatcgccgggattccgataaagatcaggcggcgccgcgtgcaaaaaaccttgtgagagcggctcatatttatattttctctgcgcctggccggtagcggcgagcgcccccatcgtattgccgtgatagcctctgtaccgggagatgaatttgaagcggctgtgatcgccgttttcaatgtggtattggcgggcaattttgaacgcggtttcatttgcttccgatccgctgttggaaaagaagattacataatcgccgccgagccattcattcagtttttccgcaagctcaatcgcgggttgatggctttgggtcagcggataataaggaagctccttcaattggctgtaagccgcatcggcaagctcctttctcccgtatccgatattgacgcaccacaatcctgacatgccgtccaaataccgtctgccgtcaatgtccgtaacccaggcgccttcccctttttggacgattatgctgtcatccggctccgcccctttcatcgcgtgccaaatcagctctttatccttttgtttgagtgactgatttttttgtacatgttccacaccgctcatctccctttcaatatcattgcactgtatcgaaagctgcccggcttctgacgccgattctcatggtgaagttttcctcttaataagaatataaaggcgcggcatgggcgagtcaataaagcggcggcaattaaaaaaacgctttctcccagaaagcgaaagggctacaagagcatatcccgaaaccggggccggtgcaagtgtttttataaaaaaacccgcccttaagcggggcgggcgtttttttatttcagatgcgtaatccggtaaatgtctttgcgccggtctttcagctggcgcacggttccgttttcacgctgccttcttaagatttcaaggtccacgtccccgatcacgaccatttcgatattcggattcgtttcaccgacgattccgtctctggcgaattcaaaatcagacggagcaaaaatggctgactgcgcgtattgaatatccatattttctgtttgcggcaggtttccgaccgtacctgagatgacggtgtaaatttggttttcaaccgctctcgcctgagagcagtaccttacgcgcaaatagccttggcggtcttcagtgcagaatggcgtaaagataattttcgccccttgatccgcggcaattctcgcaagctccggaaattcgatatcgtaacagatctgaatggcgatctttccgcagtccgtatcaaatacgcgcaccctgtctccggcgctgatgccccaccatttccgctcattcggcgtaatgtgaagcttatattgtttttcaatcgtgccgtcacgtctgaataagtaggcgatgttataaattttcccctcttcttcaacgaagtgggagccgccgataatgttcacattatatttcaccgcgagatctgtaaagaggctgatatagtcctcggtatattcggtaatcctctgaatggccagactcggagaacgctcttcgagaaatgacataagctgcgtcgtgaaaatctccgggaataccgcgaaatcagatctcgcatctgaagccacatcgacataatattcaacctgattggcaaattcctcgaaagaataaatctttttcatttcatattgaatgacgcagatgcgcaccggaaatgccgatttgtaatagcgctttgactgcggcagataatcgacattgttccattccattaatgtcgcatatttaatggacgcggtgtcatccgggagataattcggattgatccgcatgagcgtaaatccgttcatcagctggaaagaaagcaccgggtcataaatctgatggcgcgtcacctgttcgacataggctctcgccgtcatttcttccgcatacttatgataattcggaatccgcccgccgataatgatgcttttcagattcaatcgtctcgccaagtcttttctcgcctcatacagccggtgtccgattttcatccgcctgtattccgggtgaaccattacctcaatcccgtacagattcaatccgtccgggttgtggttcgtgatataaccgtcgtctgtaatgtcctgccacgtgtggcggtcatcatattcatcgaaattgatgatcaggcttgagcatgaaccgataatttccccttcatactcggcgcaaaactgaccttccggaaagtgcgcgagatggctgattaaatgctcaggctcccacggctccatccccggaaaacaatccttttgcagctcaataattttgttgatatctttctcttccatattccgtatgaccattttcttttcaaaacgggtcagatcaagtttctcagacaatgctgcttccccctgccggttcgttttgatcgttcaatcgctgtaagagtaattcaagttccatttccgccatcgattccagtctgtgatcgtattcttcaaataacagggcgctcgttaccttattcggcacgatgacacatttcatgccggcgcgtttggctgcgattgagccgttgaccgaatcctcaaaggcaagacattcagaaggttcaacgcctaaatgttccgcagctttcagatagagcttcggattgggcttcacttcttctacgtcgtcagccgtctgaatcacttcaaattcatcaaacaggcctaattccttcagatggcccgacacccatttaaaatctgagctggaagcgagccccaccttcaatcctaattcttttgccgcggctaaataagcctccactccgggacgcgccgtttccgtcttcatccgctgttcgaagcgcccgcgcctgatcgccgtcagttcatcatgatcgagctttcttcccagctgctcctctaaatatgcgaacggcttaaaccccgccgccgttccgatcacctttccccagacggataaaggcaatgttgaaccgtgttcctcaaacatttcctgcagcacttcatattcatgggtttctgtatctaaaattaacccgtcaaaatcaaagattaatgcttttatcaatggttacagctcctttagctaaacgtactgacctatgtatacactataccgtgaatttcttttgcattcaaaatgtaacattctcacggaaagaagagcctgcatgagtgcaagctctcttcatccgttactgtgtgttttgactggaaatattggaaagagccgctcccgcagactcatttgaacgctgatcgaccgctaagtctccaagcgcaacgatcccgaccagatgattttgatcgacaatgggaaggcggcggatttggtgttgggccatcagatgtgacgcctcttcaagactcatttccgggtttccggatacaacttgagaagacatcacgtgtgaaacaggtgtttggccgtcgcggccttgagccgttgttctcaatgcgatatcacggtctgtcagcattccttttaattcccctccgtcaacgacgggaattgctccgacattatgctggtgcatcagcgcagccgcttcctggatcgtttggttgggagaaacggtagccacgtgggtagtcattgattgtttgattgaactcattgtaaagcacccctttcgcattttattatgctcggggatttgactcattataaagggagttagaggaaagaaattgtggtatcatgtcaaggaagcaaaaaagagcctgtcaaaaggctctttatacccgtcagatcagccttctgtgaccgcaggcttctgatccggcccctgtctcgaaatcatcataggtaaagggaaaattcattccgcattcattcagcaaagcgcaatttttatcaaacagcgcccgctctttgacgtcatatacggggtgcggctttgacagcatgatatgtaccgtttgcagacaagccataatttgaaacgcttcttttaaagttccttggtaacgttggttttgtaaagacaatacgcccctttttttaaagcgctgaatttccagttcggagaaataaagaggaaagacattttgaaacaattcagaggaaagctcttgtatcgcgctttcttgtccgtcagtcgctgcgttcacaattctcacatcaatcacctttcttgccatgtgaatatccttaatctttatcaagaatagcatagaaaaaaacgcgaaagctaaggtaagtgtttcctattgaaacagccgctttccgcttgaaaaggagctttatgatatgaaacaaaatgaccgcggtctggaactcctgattacggaaaaacacgccggacaatggctgttttcagtcctgaaatctgaattccaggcgtcaaaacccgtgataacggaatggatgaaccaaaaaagcattcaggtgaatcggacatccccgaaaaacaacatcatactgaaaaccggagaccgcttattcattgatcttcaggaaaaaacgggttcttcggtaattcctgaatacggagagccggacattttatttgaggacagtcatatgctgattgcaaataagccggcgggaatgccgactcatccaaatgaagagggtcagaccggaaccctcagcaacctgatcgcttaccattttcaaatcaacggcgaacaagcgaaagtgcgccacgttcaccgtcttgaccgtgacacgtcaggcgcggtcgttttcgcgaaacaccgcctggcccatgcaatccttgaccgtcagctcgaaaccaaaacattaaaacgcacctatatcgccgcggcggaaggaaaagtcacgccgaaaaaaggcacggttgactcgccgatcggccgcgacaggtcacattccgtcagacggcgcgtctcacccggcggacaagccgccgtcacccattacaaagtgaagggctatcatcccggtgcgcagcttacattggcagagcttgaactggaaaccgggagaacacatcaaatcagggtgcatatggcaagcatcggccatccgttggcgggcgatgacctgtacggcggaagcagggcgctgtttcacaggcaggcgcttcacgccaaaaaagtcagtgtcgtccatccgatctcaggagaagaaatcgttgccgaggcgccgatgccggctgatctggctcattttaccgaaacgtatttttcttaaaccgggtcggcatatataatatatcgtttcggcgcatttccaatgtaagaaaacggatagcaagtggtcaggatcagttcctcccgcttgtgttgaagggtgatgacagacgtatcatcccggctgacgatttttgtacggctgattttataagaaaacgtgccgtaagacaaaatcacgttcagtctgtctccttttttcagttcgccggtccggcggaacaccgtgtccctgtggccggataacacaatttggccgtgatcgccaggataatagctgtccttataatgtccgacgccttttgctaaatcatctgcgtcagtcccttcgacgatcgggagctcagcgtcaatttcagggatttctaaaatgccgcttgcctcacccgtttcggggtgaaattcttttttgcgctgtgcctgcacagcgctttttgtttcgttcttttccaagacaggttctgttgctttttttgcttcttcaagcgattggttcgttttcatatgtgaatcaatgatcttccagcttccgtaacatgtgatgataacacctgcgatgatgacgagaagcggaatatgtttcagtttgttcatcgtgtgcgggttccccttttctttctgaaaagccaatatacgccggcacccgtgatcaccaggccggccaatgccgtctgatggctgcccgctgaagtatcaggcaatgggcggcctttttgtgtgccgctttcagtctgttctgtgctttgttccgaatctgcggcagacgccgtacgggattcgggaattgactgcactgtatcagatgctgcttcttttacgacaggacgttcaggttttttggtttgatcaggctgttctgctgcatccggttttttagcgggtttttccgtttgaggtttttctcctttatcaggcccggtgctgcccggtgtttccccgcttcccggctgattgccggtgtcatcaggtgtttcggcggctgatgccgtgcggatgcggccgtcggtttgataagaaatcggtgcggaaaagcttttgacatagtctactgtcgcttccaaatcctcaggccccgtcaccggattcttgccgagtttcccgatcggaccgtattttgcccccgctgccgtcgccataaattgattgactgttactgtatatcctttttcgggctgtatgtctgtaccgtccgccattttcacatccgccgcttgtccggtttccgggttccatgtataggaaaatccgctgatgctgtaatccggtccgtacaccggagaaatttgcgcgttgatgatctcccgcaaatcttttcctttgatttcaagcttcgtcagcacattgccgaacggctgtacattataaagatctccccatgtgatcggccctttttttatgccgtcccggatgcctcccccattcataagcgcaaaatcggatttcatcttcgctttcataccgtcggcaatcagatttccgagcgccgtgtcgccgtcatttgaatacccgcccgttatatcatgggccgcttccccgaccgcttcgctgataatcggtttcactttctcttcatatttgcttaatatgcctgccgcatccggatcaggcttgattttactttgatcgatatattggatttccgctgattttttcacgatatccttcgactctttatctagttcgagatcggcgattccgattgcttttccgtattcaaatgcctgcacgatcagcttgccgttgatttctccgtttacgactttatgattgtgcgcggcgaaaatcacgtcaatctctgagtctgttccgcttgcaagctttgcggattctcccgtgatggctgagccattttgttcagcagacatatgggcgagcacggcgattgctttaattccttttttcttcaggtctgcggcggcgtcattgacggcctttacctcatccgtaaacgtaatatttttaattccgtccgggatgaccatgcctgccgccgatctggttacaaccccgataaatgcgaccggaattccggaaacgtatttgatttcatacggcggcagaaaggactcccctgacttcaatttacagttggcgcagacgagcgggaaatcttggccgtcataaccgcttgtccccttaccgtccggatgatctcctccattgatgatccgtttaagctcattcgttccttcatcgaattcgtgattgccgacagttccgacatcaaaaccgatgtcttccatcaattctactgtcggttcatcctgaaaaagggctgacacgggagagctgcccccgatcatatcgcccgcatgcacgacaaaggcgtgttctttctcggctttcgcctttttaatgtacgcggtggcgtagtccatccgtccgaaagtgccatccggtttaccgtctccgttaaggtcaagctcatattgctgatcaatttttccgtgcagatcattcatgctgatgattctgagcgggatacggccggagtcttcagtctgccgttctttatacgctttatccgttccagcttcattcagtgatccggcttgtccgattgcttccgcatctttcacgctgaacatcataaaacaaaccgtcagcaaacagcacgaaagacgcaaacccctttttttcttcattcatttcccccctgtcttctaagaaatacgttagcttattttcttaaaaatcacatcacttttttgtaaagattgtcttcgctggcgcaaaatagtaaataatccccacgtaacgaaataagtcttgatgtataacggatcggcttttttcacatcttaaatgtgatttgacatgaaggaggaaaacaaccagtggaacagcagcagaatcagcagcagccgccagtaaatcaggggattccgggttcaccgcaagtgaatcacggaggacatgagcttttcgatatgcatgaagtgctggccggaacagtcggcgttttggatcaatttatgatgctcagacagtttatacaggatcagcagctggccgacattcttgaccgccagtatcaattcattctcggactctataatctgacggcagaatgctttaagaccggccaaaagccttctcaggaaacgtcgacatatatgatggaggaacagaaccaggccgtctacggtataaaaccgactcagccgaaaaaaccgaatcaatcattaaatgatgtcaaagatctcggaataagcggccatatgctcggcctgattaaagctcaagcttctctcttgacgatgagctcgcttgaaatgaccaatcccgtcacaagaagagtgctctccgcccaaattcagcaatatgtcgaaatggcgtatgaaatcttcttataccaaaacaaacacggttattatcaggttcctcagctcaatgcacaagatatgcagaccatgctgaattcatttgcgccggcgcagggacagccgcaaatgcctccgattaaaggacaaatgggacagcagcagcaaaacctccattaatgaaaaaaacggcgttggaaagctgactctccaatgccgttttctttttttcatatgcttttgtgaaatcatgttcaaattgtttcaggctttctttcgtagctgcttcaaagcctttttcaaaatcctgtgtttcggcggttttattgataatggttaagataatgccttctccgaatgtttcggttaaatcctttatcatatagaaactttgcaaataaacatccgtttcatattccatacgcgatttctgccattttcggtcggtcgttaattgatcaaacggcacgacggaaaatgcaatcggatcaatgaccacatcataatgcgcaacccactcgctcagcccctcatgaaaccaaagcggaaatacagacgtatccgtccccaattgccgcgctttttgatgaaatgcgtagtgtgtatattcatgtataatcaattgcttatacatgaaaacggccagctcatcttttttcaaaagctgttttttctcttctggcaagagccccatcatctgctcctgctctgaataaaaaccgactacatttttcaatcctgagtattgctccatttcagcttcatccgaaaagaaaatgagttcaagaggcgccgctcctttatagccgacaatgatttggttgatacgctttgcgtggtccagcgtaagcttggtcagatccaagagcggcttttcatccgctgtatagtaaatcgctgtatgtttgtaaatttctttattcatgtgttcagtcacttgttccttcgtcggaacagagcggctgttttggcctgacaggacgtacatcatacttactgaaacggctgaactgacagccaatatgacaaggactccgcacaggatcagagtgaatgccgcccgtttccccatgccgtcacgcaaacaagctcccctccccgatcctttaattttcatctcattctttactttatgctcagaagcgctgggtcgtgacggcagataaaataaaaaagccgcagcaaatgcggcttttccattcatttatttattggggtttgggaatacacgctgcaccatttggccgaattcatcaaacagtccggataccgggtggccgttttggattcgttttccgtagccttgcatacgttcaacgaagtccgggtttgctgatacatatacagtccggacatgtttatcggctgatttcaccttatcggtaatcttatttttcaaatggttggcgatggcgcctttttgtccgtttgtcagaacaacggctacataagcgctgtttccggcaacgatcacagtcgcatttttaacttcttttaaatcagtcaccttgtctgcggctttatcagccactctcaggttacggttgtcattgtgatcggtgttttggttatgacggttcactgtattcatatttgtcgcaccgtcgttaggtgtgttgcggtaatttacattctgggtgcggttgtcatttcgttttccttctccctggttccccatactgcaccctgcggtaatcagcatcggcagaagaagggcagaaataactgcttgtttttttatcatgtgaattcctcctttctcactttacgtataggtttttctattcggcgggatttatgcacgccgtttgcattctgagcggtttggataaatatcagaaggatagggaaaggtaagcgtaatcaattgaatgaggagggatttaacttgttcagacaaaaaagcggcatcagcccgacagcgctgctgatcggatcatcgattctgattgcagctttatcacccgaaatccgccggaaaatctccggaatggtttcaggccgaatgcagcataaagatggtacacactccatgcagcctgctgacctgattcaacaggctttcagcggggaatccggcggacagcagcacacggacaaagcacggcattcacaaacaggctccatgcagcctgccgagctgatcaaacaggctttcggcggggaatccggcggacagcagcacacggacaaagcacggcattcacaaacaggctccgtgcagcctgccgagctgatcaaacaggctttcggcggggaatccggcggacagcagcatgagcagacttcccgcaatcactccggctcatcccatacggacggacaggcagaccgcagtaaagaaacttcgccgaagcctcactataccgagccgattcacttcgaagaaagcgcggtaaatgttttaaatgacagcaccgtgatgaatatgctggaagaaattgaacccggaaatcattagaaacgaaaaaaatccttcattcgttcaacgatgaaggatttttcgttttagcgctatctgcttttttattaagcttcttcagcttcaatgacgattgaggaatcattgtacaccgcggtatcggtttccttcgtcattttacttgttaacagccctgcggtcatactgccgctgacatttaaggcggtacgccccatgtcaattaacggctcaattgaaatgagcagcccggcaagcgcgacaggcatgttcaaagcggataggacgagcagagccgcaaatgtcgcgccgccccccacgcctgctacaccgaatgaactgattgccacgatggcgatgacggagatgataaatcccggttcaaacgggttttgccctactgtcggcgcaatcatcatcgcgagcatcgccgggtaaatgccggcacagccgttttggccgatcgataaaccgaatgaaccggcgaagttcgcaattccttcagggacgcccatgcttttttgcgttttaatattaagcggcaaagcccctgcgcttgaacgggacgtaaacgcaaacaccatgacaggaaatgcttttttcacgtatgtgatcggatttaaaccgctgaacgtaatcagcagcaggtgaacgataaacatgacgataagcgcggcgtatgaagcgatcacaaacatccccagtttcgcaatgctgtcgatgtcgcttgtcgcgatcgtctttgtcataatcgccaataccccgtaaggcgtcaatcttaaaattaacgtcacgacgcgcataataatcgcgtataccgcatcgacaattccgctgaacgtcgcagcgtgctccggctgcttccgtttcacgcccagaaaagcgatgccgaggaaagcggcgaaaataacgactccgatggtggaagtcggtctggctcccgtgaaatcaagaaacggatttcccggcagaagctcaacgatttgctgaggcagcgttttggccgtcatatcctcagatttttgctgcagctcctggcctcttgataactcggtgcttccctggtcgatatggacggctttcagatcaaaagaaagcgccgaaacaattccgactgccgcggcaattgctgtcgtggcgatcaaaattccgatgatcagtccgctgattttcccgatgttatgggtcagtttcagcttcgtaaatgcgccgagaatagaaataaagactagcggcatgacgatcatctgaagcaatttgacataaccgccgccggcgatattaaaccaatcggccgtttgtgtcacgatatgtgatgccggcccgtaaatcaattgcagtgcaaaaccgaatacaatgcctagtccgagcgcggtaaagacacgtttagaaaaggaaacgtgttttttttgcatgacaaacagacctgctataagcaaaagcataataaaaacatgtaagactacaaataaattctccaaaacaggtaaacactcccttgctcattatcctttaacactatattatatcaattccgatcggtcaagtaaggattgacaatatatgtatttttattgatttttctcttttctttccaccctttctctagtaacttatataagggtgattgttatgctgaaggaactgtttcttaatttaacgattttaatcacatttaattatctgttcacccttctttttaaagagtcgctttcgtataaagaagaccgtccgatgtttcaattactgaaggggacggtctgcgggcttttaggggtttttctgattgctttcggcttttcttactccgattccatcattgatctcagaaatatccccattatcatcgccgctctttacggaggctgggtgtctacggcagccgcctttgcgattatcgtcgcaggccgtatcctgatcaatttcaatgcaagcgccattttttccatcgccgccgtcggggttattgcgatactttctgcggccgtcctcagaggaaaaaagccggatcataaaatggcgttcgttatgctgcttttttcaaatgttattttcaccttgacgctgctgtttcttatgcctgaacagcctgccggggccctcgtttattattggctcatttccatcttgggcggaatgctgtcactgtatatcatcaaacacgaagccgatgcccgcgttttgttcaagcaatacaagtttcaagcgaattatgattttctgacggggatttttaataagagaaaattcgaggaagtctcgcgcgttctgtacgatcggacgtctcaatccccctcgtctcagctcgcgcttatttatttggatattgatcactttaagcagatcaatgatcaatacggccattatgaaggggaccaagtgctgaaggaactgggggcgcgcctgaggttcttactcagcagttctcatacgtcagcccgcatcggcggggaagaatttgccgtgcttatgcccaattgcacgtatacaaaagggcttcacctcgcagaggaaatcaggcacacgattgacgcgaacccgattctgctgacgagcggagatacaattcccgtgaccgtttccctcggcatcgcgcattatccgacaaatacaccggaccctcagacattgcccctgatcgcggaccggatgctgtacaaagcgaaaacatcagggcgcaatcaagtgtgcagcactgaaaaaaaagaatgatcgcccgaagaggaaatcattctttcttttcagtgagaaagccgcccctcaggaaaacgggaatcaggctgccctcatattctttttcaatcaacgccgcggtatcatctgattgatacaaagacaggagtttttgcatccgttcatcatctttatcctcagctctgacggcgatcagatgaatatacgcttccttcatttgcgccgatcggatcagcgcgtccttctccgcatgaaatcctgcttttttcgcctcgctttgactgagaactgctgcgtcagcatgttccgccgcctgataggcgttcttttttgtttccgtttttaaggtcagatgcttcgggttgtccttgatcatatccgttgaccccgtaccgctgaatccctttttcaatgtaatcagtccggcctcctgcatgagaaaaagcgccctgccgaaggccgccgcttcatcaggcacggcaatgaccgctccgtccggtatatccttcagccgtttatgttgcttggaatacacccccagcgatgccgcatatgtcgttcctaaaggggccagcttctttttcacgtgaggcggcaaagatttaaaattagtaacggattgaaacgcattggcgtcgagatccccgccggcaagtgccaaatcggcctcagcataatccgaaaacgttaccaaagaaagctgcaatccttcctcaccggcttttttcgcgacaaactcccagatcgattgatcagattcattgattccgatagtaatggtccggttcccgtcaggataatcgcatgaagtaagtgacatgatcaaaatgaaaagaaacagactgtttataagccgcagattcaagttgacctactccctatctatttttatgtacagaagctgcaccatggtattcgggctcatgattacatacaataccgattaaaaaaagggttgtcaattgcttccttaagaggctgcaaagcggtttttatcagctgcaaatgggctgttctggtctcaaatcagatttccgtatcagagcgttttcctcttaaaacatgttatttcgaaaaaagttacatttagcagttgttttttcttcggattactggtagagtaaaggtaattatttttgttcgaactatctttaagaagaaagttttgtaagagttttcgtcttggaagtttgttttagagcaagaatagtgaatttaagcgtttgtcgctttaggaggaaatttcatgttagaaggtaaagtaaaatggttcaactctgaaaaaggattcggattcatcgaagtagaaggtcaagacgatgtattcgttcacttctctgctattcaaggcgaaggcttcaaaactttagaagaaggccaatctgtttctttcgaaatcgttgaaggaaaccgcggaccacaagctgctaacgtaacaaaagcataaattgtttaaaaaaacctgccggtgtacgccggcaggtttttttcatctaaaacgaaaagctgttttgcaaaggcaaaacagcttttttatatcaggtggcaatatcccgttttaagaagacgccgaatgcaagcgccagaaaaataacgaagtaaatcacaagcatcacaaccgaaaatgtcatcgtcatcccctctactaaaggagtcccgttcatatattgcgacaaatccgtgttcgcaaataaaatatatttggtccattcaaatttcgcagcaagaaataccgtcgccgtgttccccataaccaatagaaaaatagaaaatccgaccgctaatgaactgttccggaataccgcagacagcataaacgccatcgtcgcaagcataaaagcggagacagattcatagacatatgttttagcgaggaaagcgatgatattttgctcaaaaacatggccgtctttgtatacgagatgaacatcagccgcagtatctccgcctgtaccgaaaaagaccaatcccaacagagcggagccggcaaataaaatcacaagcatcagcagtccgaacagcagcactgtcatatatttagaaagcaaaatctgaaaacggctgagcggacggatggccagcagcttgatcgtcccccagttgaactcattcgccacgatgcctgcggcaatgataatcgtaaacagcccggtcaaaacagtcatcatcgaagaatcagatacgtatgaccacactgtgtaccctgtatcctcggggatgttatgatccatacggtattgatttatcgcgacattctgtttcaggttatcaatgagcgtctgatttccggtttccttcatctgctgtttcatttctttgttttcagcctggagctcctgtttccaattcggattggcttcgttcgaggtgaaatggtttgacagaagcgcaaaaccgatcatcgaaacgcctaaaatcacaatcatagcccacgtgccgacgcggctgaaaattttaatccattcattatagatcagcttaaacatattgaacctcctctttcgtcccgccggtaatttccaagaaacggtcttccaaagattttgtcatgattttcacttcatataagcggatgttttcacggacgagcagtgatatcacatcaggcacttcctgtttggacagctggatctcaatgccgtttgtcttcttcacacagtcaaactgactcaaaacggcaagagcctcttctctttgttcaatatggaagaagtatgtatctttatcctcttttccttcatcccttactttttgaatatcgacaagctctcctttttgcagaatgccgattcgatcgcacattagctccatttctgacagaagatggcttgagacgatgacagccattcctttttcacgtgtcagctttttcagatggtccctgatttctctgatgccggcgggatcgaggccgtttgtcggctcatccagaatcagcaccttaggattatgcagcaggctttgggcgaggccgagacgctgtctcattccgagagagtaggtttttactttgtcatgtattctgtcctgcaacccgacgagctcgatgacctcatctattttttctttcgtaacgccttttaccatccttgcgtactgctgtaaatttttatagccgctcaggaatttgtacagctccgggttttccacgatggctccgacgtgcctgaccgcttttgcatagtttttcgtaatggattccccgcagattacgatgtctcccttagacagtttcattaatccgaccatcattctgatcgtagtggttttccccgctccgttcggccctaaaaatccaaacacttcgcccgcccggacggagaagctcagatcatgaataatcgttcgtccttttatcgttttctttacctgttgcagttctaataccgtttccaattagaatcccccttctatttcgtgcgcctgcatgacgtttctataccattgcagcacggacattccttcctgttcccgaatttcttcgacctcgcgccgttcagcgattttcccttttatgaaaaccatcacttcgtctaacagcgtctcaatctcgccgatctcatgcgtggcgatgacgacgatctgactgtcaaaatcaatataagatacgagactgttgacaatcgactccctgaccgccggatcaagacctgaaaacggctcatccagcagaatgaccgatgcttttctcgacagggccaaaacgattttcagcctgccccggctgcctttggacagctcttttaacttctgcttcgctgaaagattcatttccgctaataggttatgtgctttttccagctgaaaatccgggaattgcgaatgataaaacgtgagcatatcaccgacggtcgtccgggcggaaaacatatcatgttcggttaaataagccgtacgaaacagcatgttcctgcttactttgcactctcccatccggacggcgcccgatgtcggaaaagcaagccctgcaagcattttaagcgttgttgatttaccgcttccgttcggccctaaaattccgtagattttacccggagacaatgaaaatgatacatcgctgaccgcgatcctgcggccgtatttttttgttacgcgttcaaaatcaagattcatcgtttgcttcctccgcatattgtttgatcccctcgagcatttcctcaggagataaccccagctccgccatttcctgaataaagcgtttgaaaacgtcttttgtcagcctgtctttcagctctgctttcagatcggatctttccgctataaaggttccctgtcctcttctcgtctccacgatccccagcctttccatttcactgtacgttctttgtatcgtgttcggattcactttcatctgtacggccatctcccttacggacggcagtttgtcccccggtgaaagctcacttcggatcagccggtaatatatacgatcggcaatctgcagataaatgggcttggatgactgaaattcattctccatcattacacctcaacctttcgattcagcagtatagaggccagcgcgagacagagcgctgcaagcacgatcactgccagaaagctgaaaagcgaaatgtggacggctttcagctccatcgtccatccggacaatttcgtataatgaaaatgaaaattcgcatacacttttaccggccataaatcatgttgagatgaagtgaaaggcgtaatgattttatcgtcaatataggtccagacaaacgcaagcacgatgcagatcccccaacggaggacgggaaaatgttttaatgagtgaaaaacagtccaaaatacggccacgatcacagataagtacgctgaactgatcagcaggtaagcattcagcccggttaatgtgccggccaggggaatggtgtgttccagcactccttttgcagaaagcatccggtacatccaaatgccgtaacccgtcagcgccagctgcccgatcaactgatacagcagtgaggccgtcagcttggaagccagcagataaaatcccccattcggattgtaaagccacagctggttttttccttctttatgaaggtgataatacataaaaagcggcgctacaagaaattgaaaaaaccccattgccgtaaaaaagccgaaaatgacgagcggttctttctgacgggcagcgatgacgtgggctgaaaacgcccagcaaatcatgccgcaaagccacaccgcgagccaaatccatgaaactttcgcatcttttttcagcaaacctaaaaacgatgtcattctttctctctccattcggatcaagtgtatgagtaacatagtacactagatcatcacgtattacaatatcttcaataaaaaaaagacaaatccgctcttacgcggatttgccttttcaattacttctttttgttttttaaggagagcagcgcatcacgatagctgctatcctgcattttgccgccgctatcaggatcgtttggttcctgatccgtctcagaagtcttaaacttctgaagcgcctgacggtacacatcatcgcccattgtattctttttctcacggggagattcagattttacaacgacgggagcatgctcggctgagcgctcctcggccggatcatgcttttccggctgttcggctgtagtgccgatcgcttctctcttttcttctttgacatcctgtcctgcagaagtgctgcggacattgaaggtgataagaagtgcaatcacaatgacagcagcaataaccgctataataatggccatataaccctctccttactgtcgtccggcagttagattaccagtgacctggctgacacgtctgccaagcgcacggcctaattgaaggccttcttccgtcatcagcacatcgctgtcaaccgggcatgtgacgcccgcgccgtagtaagagccgtacagcgcgttttcaggaacgttgccgggaagaccgacaacaatcatgccttggtgaaacataggagtgatcagattgtgcatggtcatttctaatccgccgtgtgttgtcgccgtcgtacagaatacagcgccgactttatcaatcagctcgccttcagcccacagatagccgagtctgtcgatccacgcttttaagcctgaactgatggtgccaaagtgtcccgggcatccccagataatggcatccatgtctttcagcttgcggatgtctgcttgatcgacatggtcgatcaggacttcagcctcagcgttttctcgtgcgccctcggcaatggcttcagcaagatgttttgtgtgttcgccttcactatcgtacactacgtaaattttcattcaggaaacctcccattcagatgattaagattccttcacttctttaggggccggaagcaatgacagctcctcttttttcttcgcccgctgtttgtctttccgcacgtcacgcaagaacagactcaggactacgccgataaccgcaaagatcgtcgcccacataaacgcgtcattaatccccataacgttggaattgagtgaagctgttttgtagagatatgaataaacggtttgtttcgccgcatcaagcgacatgttcatgttgaccattaaattcgaaaccgcgctttggaacgactgcatgaagcttggatcagccgtgcttgttttatccgcaatctgcgaataatgcattgtcgtacggttcgtataaatcgttgtgatcaaacttgttccgattgatccgctgatctggcggagcgtgttgctcatcgccgtgccgtggctgttcaaccgtgccggaagctggttcattccggctgtcataacaggcatcattaacagtgacataccgaatgcgcggatggcatagacaagcatgatgtgcgtgtaaggtgtgtcaattgtcaattttgtgtactggaatgtcgttgcgaccgtgatgaccagcccgataatcgcaagcggtctcggaccaattttgtcaaacagaataccggaaatcggcgacatgatcagcatgacaatcgcgcccggcaatagcaagagacccgattgcagcgccgtaaagccgactaagttctgcaggtaaatcggaagcaggaacattcctgtgtaaagcgcaacggtaataatgatattaatgacactggaaagtgagaaaatatcatatttaaatacccggaagtcaagcatcggtttttcagagcgcaattgctgaatgacaaacgcggcaatcgcgatgacaccgacaatgacggtagacagcacgatcggatctccccagccgtcgctgcccgcttcactgactccgtaaagcaatgaggcgaatccgacaatagatagaatcgcacccaagctgtcgagtttgattttttgcggttccaccaagttcttaaagaggaaaaacgctatgataataacgattgccccgatcggaacaaggccgtagaacataatgcgccatgtgtaatgctcgatgatccagccggatagagtcggtccgaccgccggagcaaacatcatcgcaagaccgaaaatccccattcctttccccctgctttcaggcgggaagataagcagaatggttgtcatgaccagcggctgcaggataccgccgccgaccgcctgaattaaccggccgatcagcatggttgagaagttaggcgcgattccgcagactaacgttcccgctgtaaaacagaacatggctacgagaaagaggcttctctgtccgaaccgggtgattaagaacgcagataacggaatcaaaacaccgttgaccagcatgtatccggtcgtaagccactgaatcgtcgtcgcactcacaccgaactcggtcattaagtgcggcatcgccacgttaagaagcgtttggttcaagatcgccaggaataacccggccataagcacaataagcaatgttttaggactttttacttgattatctgatttagccacctaagacaacctcccttcatggtttgatgactgatctgtattattcagagatttttacagatgcgttcataccaggaagcaccttgtcagatgggttgctgagtgaaattttaacaggaactttttgcgttactttagtgtagttgccgcttgagtttgaagaaggcagcatatcaaatgttgaatttgtcgcataaccgatttcttctactgttccgtcaaatgttgtattaggatcgccgtcaacaattacgtctactttgtttcctacttcaatgtctctaatgtctgtttctttaatgtttgcagtgatgtaaaggtgtttcatgtcaatttcctgggcaattgtcgtaccggcttgcaccatttggccgtttttcacttcgtttttcacgattgttccatccatgatggcttttacgtcagcattttgctgtcctttaatttttgcaaccacgtcgtttttgcttacttctttcccctcatcaaggttccagtcagttactttacccgcagcaggagctgtgatagcagccatgtcgccggcaactttcgcttcatcggtttttacatagtgtgtgctttgataatagtagtaagcacctccgcctataattgcaagaacaacaatcaaaccgataatgttggtcagaattaaacgtcctctgttcattttgttttctcctttcgtttcttcctctatcattttgtggaatgatgataaaaatatgtggggatttttttattttccgtttttcactgcacagccgtttgcaagcttcgttaaactttccgcaagcttgcgcaggtactgcagttcagcggtattgagctgccggtataagaccgccgctttttcggcatattgaacagcagctttctttagaagttcttccccctcttcggttaactgaatcataacaacacgccggtcgtcgtgatagtcgctccgaaccattaggcggcgcttatacagaatatcggtcattctcgtgacagacgccggtttcagatcaagcgacaaagccagccttgaaagctgcgtgcttttgctcttatgtattttgaacatcagcagatactgcagcactgtaatatcaaaaggttcaagcactgtctccagaatcattttctgctttttgtaaatcgatctggaagtatcaaacagttgttcaaaactgagcaaagcgagctctgattcaatcaccgtattttcacctcattcccttaataatagttcacaagataaaatattaataaatgaaagaaggtttgtaaagagaaaagtttcattttttaaggattttttttatgccgttttttctctttatttttaatttaaaaaagccgggtgaagaaccgcggccgcacgattcttcactcggctttatatttaatacgatgctttgcttataccggcttcctcatttttaaaaaagcttttcagcgcttgaaatacgtccgatttctgtttcaggatgtagtatttaaatttatcatctttgacatttttataggcggacatgagggtggaatgcctgttatattgattgacctcaccgtaacagaacagattcgattttttcatgatgtcattgacgagctttacgcaccgggcgttatccgaagtcaggttatctccgtctgaaaaatgaaacggatagatgttgtagcgggcggggtcatatttttcatcaattaattcaagagacttccggtaaacggaggaacagatggtgcctccgctctcgcctttcgagaaaaaatcttcttccgacacaaccttcgcttccgtatggtgggcgataaattcgatatcaaccgtttcatactttgtccgtaaaaatcgtgtcatccaaaaaaagaaactcctcgccatatacttttcccatacgcccatcgaaccgcttgtatccatcatggctaaaacgacagctttcgattccggcttcgtcacatcattccatgttttgtatttcagatcttccggataaatagggtaaaacgacggcttgcctgtcatggcgtttcgtttataggccgacagcatcgtccttttcttatcgatattccctgtcagcccggttttccggatatcattgaactcgatatcggtatggacgatattgtccctttccttttgctgcagattcggcagttctaattcctgaaacagcgcttcttccagatccatcaatgaaacttccgcttcataataatcctcgcctgcctgatcgcctgctccctggccttttccggcgccctgctttttatctgcgccgtctcttgcgacgacatcgccgacttcgctgtcgccgtcgccttggccgacatgtttatttttatcatagttataacggattttatattcatcaagcgaacgaatcgggattttcacaacatcttttccgttggacataataatgctttcctcagtgacaaggtccggaaggttgttttttatcgcttcctgcactttcttttggtggcgctgctggtcgtcaaagcctttgcgatggagggaccagtcttcctctgaaatcaaaaaatttccgctgtcattacgggacatgaattcccctccttaaccgttatggtcgttttacatgtgtattccggcttggtcctgtttatgaaacaagtccggcgaaaagatttatttttatcttatgccggccggactctccaattgacaaacaattgcgaaaaacagacaaaagaacccgtccttttacagacgggcctctcaatgaaatcaaatatcagcggtttaacaagcttccgacatacttcagcagttcattagcgctagtcgaattatagccgtgttcatctattaaccttgccactacctcattgacctttttaagctgctgttcatccggcgttttggtggaggtcgtaattttcactacatcttttaagtctgcgaacagctttttctgaatcgcttcgcggagtctttcgtgcgaattatagtcaaagcgttttccttttcttgcataggcggatatgcggattaagatttcttcgcggaacgcttttttggcgttttctgaaatgccgatctgctcttcaatggatctcatcagtttttcgtcaggattcatttcttcacccgtcagcggatcgcgaagcttatttttattgcagtacgcttccacattatctaaataattgtccatgagagttttcgcggattcttcatatgaataaacgaacgccttctgcacttcctttttggcgatgtcatcgtactctttcctggcggcggaaataaaattcatataccgctctttgtcctcggcggagatggacggatgctggtcgagtccttcttttaaggaacgcagcacgtcaagcgaattgatggattccatattttttctgataatcgttgaggaaatgcggttgatgacatagcgcgggtcgataccgctcattccttcatcatggaattccttcttcatatcctccagatcaacggaattgtaaccttcaacgctttctccgtcatagagcctcatttttttgacgagatcaatatcagagcggttcggttccttcagccgggtcaaaatagaaaacatcgcggccacttttaatgtatggggggcgatgtgtacgtcagaaacatcactttcagaaatcattttttcataaatccgttcttcctctgacacctttaaattataaggaacaggcatcacgatgatcctggagtgaagggcttcgtttttcttattggcaataaacgagcggtactccgtttcgttcgtatgcgcaacaaccaattcgtcggctgagatgagcgcaaaccgtccggctttgaaattcccttcctgcgtgagtgacagaaggtgccacagaaatttttcatcgcatttcagcatttcctgaaattccatcattccgcggttcgctttatttaattcaccgtcaaaccgataagcgcgcggatctgattccgaaccgtattcggcaatcgtagaaaaatcaatgctccccgtcaaatcggcgatatcctgtgatttcgggtcagacgggctgaaggttccgattccggtacgtttatcctccgagaagaatatacgttcaactttaacatcctcaattctgccgccgtattcttcttcaagccgcatgacattaagcggagaaaggctgccctcaattctgatgccgtattctctgtagaagtcgtcgcgcagatgatggggaatgagatggagaggatcttcatgcatcgggcagcctttaatggcgtaaacagcgccgttatctgtcaatgagtaggcttcaagcccttttttcagcatggtgacaagagttgactttccgccgctgacaggtcccatcaatagtaaaatccgttttcttacatcgagccgcttggcagccgggtgaaagtattcctccacgagccgttccagagattcctcaaggccgaacagctccctcgagaaaaagctgtatgtctttttcccgtcatcctcctcgattccgctgtcttttatcatattaaaaacgcgagaatgagcagactgcgcgaccaatggattttcttttatgatctccaaataatcagcgaacgtcccttcccatttgagacgctgctcttcctctctgtacttttcaattttctttaatatatccataagaacctcctctatcatggttaatgcactagaaataaggtactttgttacaatctatgcggtgacgtgataatacatgcttttcgtttcttaaaaataaagacgttataaggccgtcattgacaagggtccggtgcaccgttcataatgaaagaaatacagtttcatccagactcggacatcaaatggaaaagcaaagaggaggagacatgatgaaaacgatcattttacttggggtcattctcacttttttagtatccatttttactgcgggttacgacagcaaacctgaaaacaaataacggcaaaagggtgctctttatgaagagcaccctttcctgtacaacataacaatgtttcatatttgaatatgttcttggacagttgatttttcatgagacttacagcttgtttgatactcgatttttccgattttgcagcccgggccgatttccacacgcttccctctgacgatgtccgcttccgtggattcgaggtaaattgcgtctccttcgatcaattcagcagaaagcatgccggctttccgtttaagaaaaccgggtttccgtctgacggtaatcgatgtgccgccgatttctttcacgcggcttcggtcataacgcaaatggatgtttacgtcccctgcgtttaacaatcccgccacattgatacatcctgttacatgaagcagctccgtctcgcaatcgccgccgacggtgagactgccttttatatgacactgttctcccgcggccccgccgccaatttcagcaagtcccttcagcctcatcctggcaaaacgcatggagccgccgactttcaatgtgccgatcacatttgctgaatgtgctgataaatctcctgcaacttcatgctctccgaaaattttcagcctgctgatctcggcatctccgagaaaaagtcccgtgccgaatatccggcagcgttcgctttgaagtccttcgccgacagttccttcccctttaatgcttacattttggtaggaaccgccggaagcgtgtccggctccgtacatttttaaatgactcaatttttttgtcgtttccattgcagctcctcctatcgtttcacgactttgttaaccaaagcggtaggatcacatgtaaaatcgccgctgtattccaccgtcccaatggtgcagcccgcgccgatccgcacatgatttccgcggactgtcttcgcgttcgtgtccgccaattcaatgatgtcaccctcaatcagctctgctgtcagcaccggggccggcatcagcttaaaacgcgtaagcacgctctttctgctcatcactttcaaatggcggcagccgatttctttcacatgactttctcccgcagccagcttcatactgacttcatcggcattcagcaggccgccgatcttgcatttgccttccgaacggaatgtctctgtctcgcaatcaccttcaatcccggctttcccggatatgaaaatatcatcagctttcacaccgccgccgaaagatgaaaatcccgcgacgttcagccgctccgttttgacatcacctttaatgacacccgttccgttgatacggatggattcagcttcggcactgccggaaattttccccgaaccgctgattgtcagtgtttgcgtcttgacatgtccgtctgtttttccgctgccgttaaacaaaaggctcgtgcactccacatcacctgacaccgtgccgctcccgttgatctccactgtatgaaaacggcctccttttgaacttcccgaaccgttaatgattaatttatctgttacttccattgatggtcctcctgcatccatttcgtttttaattcttccgatgccgcagcaagcgccacccgttcaaccactttgacagtcggttcaaataaaatatgttccgcgtctgcgatgaagcacgtcgttacgccgagctttcggagcatgacaagctccgtattcgctttcagctcggaagcctcatacgtcttcagcacccccgccgccaattttccttcctcaaggctgatattgcccgattgcaaaagcccttcaagcacatataaagacagcagcgcgcgggacgtgaatgtcacgccgtcttcgccataaacttgcagcgcggcttttgaaatcagtcccttttgaagcagttccgcagacgttatattgacatcagtcatttgcggagacagcatttctctcatttcatccagagacagattttctttcatttcctgtatttttgagatgcgttttaatatttccgctctcggaaaaaatgtttcctggcctgtaaacgtcgattttcggataaaccattcttcaggaattaaatttttccgtttccaccggtacagctgcccgtatgaaattgatgtttcttccagcaattcttttttagaaatcagttgttcctccatgaatccagctccttcgatgaacgtattgtaacataacactgttacgttgttaagcccggaaatataaaaatgccgtaaaccgctgctgcccgtcttttttattcaataaaaaaacgcccggatgcgggcgttttttctcacgtcaaatctctgtaattttgctggcgcagcgcttcatatacaagaatcgcggccgtgttggacagatttaatgatctcacatgctcggtcatcggcagacgcaggcagcggtccatattgttttcgatcaattctttcggaagtccgctcgtttctctgccgaatacgaagaaaaagtcttcctccgtatttgagtaatcaaatgatgtgtgcggcttttgaccgaattttgtaatgaagaaaaactttccgttttcatatgcttcaaataactcttccaatgaatcatgatatacgacgttgacgaactcccaataatcgagtccggcgcgcttcagcattttatcatcggttgagaatccgagcgggcggatcaaatgaagcgttgtgtctgttgccgcacaagtacgtgcgatatttcccgtattggccgggatttcgggttgatataaaacgacatgtaatgccacgatgttcacctctgttttttattccgcccaccattatatcattaattactcttttgtcgtatcatccgtaatatgaaaaaacgcatatctgatggaaggagtatacgccgttgaatcctcatatgaccaatatctcatcctgctgtcatacgtttgggcattgacgagcggcatattgcttttatcttttgcgaccacgatcgccgtatgattaaaacggccgtctccttcaaaatcatagcaaatgatatctccgggcatcagttcttcagctcttgatacttgcactgcgcgaagccctgccttggattgggccagatacatcttcatcgaatgcgcgaccgtccagctgtagctccacgagcttgccttcatccaccagcctgagcctctgttcggatgcccccgcatcggtgcttttccggcatgtaaacattgggaaataaaattggtgcaattatcgctgaaatttttataagcgggatttcgtttattccaaaacttctccgcgtactgcacggcagccagacggtcgtattgaaacgcccgcccgaaatcttcccgttcactccgctcatattcaattacgctgtttccgtcagaaaatccagccggttttttctttacttcccggtctttaatcaaaagctcatcatagagaaatgcagtccgttcctcaatctgctcttctaagtaaaggtgtccgtcatgctccttgcacaaatattcgaaatgaatcgtgtacatgacacataacgtgccgtcgtcctcaagactgcttttgacaatgacggcttttgccttcgctttcacgatatcaactttccgtttttcaaacagctctttttttctcgtcaggacctcaagatcgccggcctgcccattctgcctcatctcagttccgttgattaaataatgaagccgggcctccgctaaatcttcaataatatgcttcaagcgctccacccaccatacgattttataaagaaaaaacacttgaactccggccaagtgctttttctctatacatatgtcaggaccggccggttttagtcttctcagaaaccgataacagctccagtcccttttcaatttcccgtatggcgtcttcatcctgctccttttgaagcgctttttctaattcctccgcataatcaggatcaccgattttcccgatggcccaggcggccgtacccctgatgacggggcgcggatcttggtgcatcaaggccgttaattccggaagagacgaggcatctttaaaatgagccaaagctaaaatcgcattccgctgtatcggcttcttgccgcgccatgatcccgatacatgtccgaatttttctttgaattcgcggttgcttatggtcaaaagcggctttaacagcggctttgcgatttccggatcaggctccatctgcggatgaagatgaaaatctttccccttattaatcggacagaccgtctggcacgtgtcacagccatacagacggtttccgattttcgtgcggaactcatccggcaaaaatccctttgtctgggtcaggaacgaaatacagcgctgggcgttaagctgtccgggattgacgagggcgccggtcggacacgcgtctagacattttgtgcacgtaccgcacatatcttcaatcggcacatccggttcaaagggcagattggtgatcatttcagccagatagacgtaagaaccgtattcaggcgtggtgatcatgcagtttttggcgctgaagccgattcccgcccgttcagccacggccctgtcggacaattctcctgtatccaccattgactttgtgcggatatcctcatgtttgctttggagaaaattctccagcagatcaagcttttcccgcagcacatcatgataatccttccccaggaagctctgcaaaaaatgccgcgccgcccgtccctcgtgctcctcggcgcatctttcattttggaaggataagcaagggcgatggcgacgattgatttggctttcgggagaagcaaagacggagtaacccgtttttcaatatccggctcttcaaaaccggataaatagccgagtgattcctgaagaatcagccggtcccgcagactgtcgaacgtatcagccgttgtaaacccgattttgtcaactccgatgcttttggcgtattcgattaattcctctttcagtttatgaatattcattttttgcacagcctcctttctttgtgatcaggctcccgcacgggtataatagagttttatcatcccgaaatggagtgaacacacttgaacatcagtttagatccacttattgctgaacgggtgccggggatcaaagcggcagccgtcttatatgaacagatcgaagtcgggcctgctccgcaaatgctgaaaggccgcctccgtttatttcaagaatctctttactttgattatgctgacggcggtatagatgagcagccttttgttaaagagtgggcgtgtataatggaacagctcagtcccgccttttcaggacaaaaaacgccgatggagcttatgctcggcgatatttcccgggaacgattcattgaaagtgtgaattcagcccatgataccatactttttttctccttgaaatattcattgcctatcatggcgtatgacgccgcagaaatagatgaaccgatttcgattacaatcggagaaaaagaacacgtacttgctttctccgactctggcggcattttcggcggccttaccggacatatcaacacccgccctgtaacaatcggcacaaagaaaatgctgcagctgatctttttcccgccttcatttcatgccgacgcggcggatgagctgctatcatctttaaccaaaatgtttgaacaaattcacggaggcacgcataccgtctcttggctttcataaaaagacacgccttcgtgtcttttttcacataaaaaaacgcaatacttcgtttatcagagaaacgaaacactgcgttaataacgtatgtatggagcgggtgatgagaatcgaactcacgacatcagcttggaaggctgaggttttaccactaaactacacccgcatcaaagttttttgtcagtaccgatttgatgtttctaatattacatgtatatttttttttcgtcaagggaatgttaaaaaatttgtcgaaaaaaattcttttttcgtccacatgttaagttaggtttacattttgttaagaatctcatacaatataaaaaagaagaaaacttgaggtacgccctgatgatgaaaaataaagtaaaagagctgagagccagattcggctattctcaggaaacgctcggaaaagaagccggagccaccagacagacgattgcagcgattgaaaaaggagattatgtgccttcactcttattggcgcttaacatctgccgggctttctccctgccgatggaggaagttttctggctggaggaggagaaaaaatgagtttgaaaagaaaagcgtgttttcaccttgcactctacggattggcctgctggacgcttatttcctttatggaagcggcgccgcggatcgctcagtttttccaaacggaggggagcggtgcatttgagctgaatatcactccgtttctgctgtttaccgtttgtgccgcattgtatatctatgccgaaaagaaaaaacgaaacggcaaaaagcataggctagtgcccgatgaatttgaggaacaggatgaaagagaacgaatgatgacggctaaagcttgccgttcctcgtatatcgccgtttacttctcattgccggccgcagccgttctgcttttgttttatccgctgattcagccgcatctacctttttttccgattcttttgattttcattctgatgatgattcagcatttggcttatgttttcacttttcataagcacggcaaaaactccggttcatgacagatccggagttttttatgttaccagctcgcttttttcaccccgggaacccggcctttatgggccagctccctgaatgcgattctggacagtttaaattttctcatatatccgcggggccgccccgtcaccgtacagcggttatgaagcctggccggagcagaatcacgcggcagtttgctcagcgcttcccagtcgccttttgcctttaattctcttcggatgtccgcatattgttcaacaagcttctgccgcttgagctctttgattacttttgatttttttgccatttcagcactcctaacaaatcgtaataattacgttttgtatcatatcatccagatgagcatcgtgcaagctaagcgcttaaaaaggcgggtgaatacccgccttcactgccggcatttccccggaaatgaatccgcagaaagcgcccgccgtcaatgatccgccttgcgacgtcatcagactgtcgctttatttcctcttgcaaaatggtcgtttcccattgcttcacccactctgcgctcaagcttgttagtccgttcattctgaaacggcagaagcggaaacacgagttcagccagataataagcttcttccagatgcggatagcctgaaaagataaacgactcaatgccgagtgcctgatactctaaaattcgatcagcgacagtctgcggatcaccgacaagcgccgtgcccgctccgcctctgaccagtccgatgccggcccagagattcgggctgatctcaagcttcgagcggtcaccgttatgaagatcggccatccgtttttgtcccgatgaatcagcgcgccggagcgcagcctgcgctttcgcaattgtctcttcgtctaagtggctgattaatcgttcagccgcttcccatgcctcttcctcagtctcccggacaatcacgtgaagtctgatgccaaaacgcatcgtccttccttccttggcagcctgttttttaacggtttcaatcttttcttttacctgctccggcggctctccccatgttaaatagacatctgtatgtttcgcagcagcctcaattcccgcctgtgatgaaccgccgaaatataatggcggatgcggagactgttttggcgggaacaggaggttgctgttttccaccttgatatggtccccttcatatgtcaccgtttcgccccgcatgagtccgcgccagacggttaaaaattcttcagtcgccttataacgttcatcgtggctgataaacatgccgtctcccgccagttcataaggatctccgcccgctacgacatttacgagcaaacggccgtctgacagccggtccattgtcgacgccattctcgcggcgacagacggctgcatcagtcccggccggaccgccactaaaaatttcaagtcactcgtttcccccgctaaagcggcagccgtcagccacgggtcttcgcatgatctccccgtcggcagcagaacccccgtatacccgagtctgtccgccgcctgtgccacttgcttaaaataaagatgatccgccgttctccctcccgtttgcgtccctaaataccggccgtcaccatgcgtcggaataaaccaaagaatctccatatgaatctctccttttttaataggttacccttcataactgttccgccattttaatagtttccgttcgagcattctgaccaatgcatctgtcagcttgccgacagccgcaaaaatgataatgccgacaaacaccttatttgtctgtgaaaattgtctggcatccataatcatataaccgacgccctcgctcgatcccatcagttccgccaccacgagaccgagccacgcaatgcctagggagagcctgatgccgagcaggatattcgggagagatgccggaagaattaatttcgtcatctgctgataccaattaaattccagcacccgcgcgacgtcaaacagcttcgcgtccacactgcggattccgagaaacgtattaatgtatacgggaaaaaaagcccccaatgcgatcagcagaattttagatgtctcatcaaatccgaaccacaaaatgaacagaggagtcacggccaagtgcggaaccgtcctgagcatttgcagagacggatcaaggtatgcttccgtccgctttgaaaaaccgaccagcagcccggaaacaagtccgaggcccgcgccaagcagaaatccggcagccgcccggtataaactgatctctaaatgaccccaaagctcacctgaaagaagaagttcctgaaacgtctgcaagatgacgacaggcgacgagagcaccgcggccgagacgatgcccagacttgcgataaactgccatactgcgatgaccgcagccgggagtacaatccctttcatccattggtatgaatacttccgggatcttgccagagctttcttttctgattggcttattgcgccggcagccgttgatgcttctgctttcattacttgccatcccccgtttcaagcgcttttttaataaatgaattgtcgacaacgtcttttacatgaattttcttatgaatcgcttttgttcgatattgaaaatcagcggtttcctgctgggctttgacaatatcatcatcgatcggttcattgagaggctcagtattgttaagcacgtttctgacgactttcggatcaagatgtttgattttcgcatataaggagacggcttcatctttgtgttccttttgccatgtaactgctttattgaacactttcagaaaacggacaacctcatccgggtgttctttggaaaatcccgttctgactaatgtgaaaccgggagaatataaatctgtgctttctccgttcgccaatatttccgccccgtgctgcagcgtttcaatcgacaaatacggctcccaaatggaccatgcgtcaactgatttgttttcaaaagcggaaaccgcctcatcgggctgaagctggatgatggtgacgtcatcggcggaaagccccgctttatctaaagctttatagagaaaatcaaagccgctgctgcctttggctacggcgatttttttacctttcaattctttcaggctctgaatcccgctgcccttgtttacgagaatgccgtttgcctttaacccgtcctgagacagcccgatctctttaaaatcaattcccgccgcctgaccggaaatgaccggtgaattgccgacctgggaaaaatcaagcttatcggcggcaagaccttcaaattgcggaggaccgctttggaattcgacccattttacttttattccgtcttttttgaaggcctcttcaaaccagcctttttccttggcaatgagaagcgggcttaaactctgctggatgccgatccggatttctttcaccgttttcccgccccctcctgtcccgtctgcactgcatccggctgacatcatgactgctgcggctaaaagaatgatgatttttttcacttcgcttcgtcccttctatattccggacccatccgcaaaccggaggtcttccgttttctcaaattcagaaagcaccttctgccggacggcctgaaaatccgctgacgtccgattgcgcggatgcggaagctgaatcggcatcaggctgtgcagccggccgggctttgccctgaggatcgccagcttatcgcctaaatagacggattcatcaatatcatgcgtgacaagaatcatcgtcgtttttttctcgcgccatatatcaagcagcacatcctgcaaatgttttctcgtaaaagcgtcaagcgccccgaacggttcatctaaaagcagcacctccggctcacgcaaaagggctctggcgatggcaacccgctgcgacatgccgccggataattcgcgcggataagcgttctccgctccctgcagcctgacaacctcaatcagatcatccacttttttccgaacggccgggtcgttcatattgagatcggcagcgatgttttgttttaccgtcagccagggaaacagccggtgctcctgaaagataaatccctgccggatgcccggtcccgacacattgcggccgtttattgcgacagagcctttataatcggtatcaagaccggcaatcaattttaaaagcgtgcttttgccgcatccgctcggtccgatgacagtcaaaaattctcccgatgcaattgacagctcaatatcattcagcaccggcgttttccggccttcatgctcaaaagctttttcttgtatgctgatggttacagccatctgtcttcccctctctttctgccgcatgcgatcgaaaaacaaaaaggcccccatctccgattgcttgcagagatgggagccttcggcggtccgatcggcaacccgtttgtttttaaatttgaatatcatgttaattcaaattattccgacttgtcaactgttttttgtatgaattaaaaatgcgccttccggcataaacctgccaaagagcgcatcggctgtatcacgtatttacttccttttctttccgggcgattttcaataatgtctgcgcgttgttgccgaaaatgttttctatatcttcttcccgcatattgatttcccggcaggtcctcacctgctcctgaagatatctgtatacatatcctctcggaaatccgttcgaatccgtcccgaagatgatccgttcagcaccgattaattcagatgtctttcgaaacagaatttccaaatcaagccggtacggcatccacctcatccactgatttgagccggacgtgtcaatatacacattcgggcagctccagcacagctgcagcagttcctgataatatccggcgccgaaatgcggaatgatgaacggtatatcagcatactctctcgcgacgcgatagatggagagcgggttgatgttgcgatggctgacaatgcccccgctctccctaaaagtccgaagtgaattaatacaggcagtcttttgtcagccagatacgtccacagctttttcagcgacggatcatgaaactcgatgtctgtcagcggcccgaacagtttatatcctttcagaccgagctcttcaaccgctcttttcagctcctcatacgcatccttttgttccaaaggatgatatgcaaatccggtaaacctcgcgggattggcttgaataaacgccgccatccggtcattgctctctgctgttaaaaaattcagcacgtcaatgccgtacttatctaattctttctcccatcttgtcatcaaagcgatttcgccgtcatcgccatcaacatcatgcggatcaggaaaatcccaagtgagattcattctttccgaccgctcccggttataatcggaaaatgtcttatcgtttttgccgaaattaaggctgtacggcagatgaccgtgaatatcgacaggtttaaaatgctgccggaaaagcatacaatcgccgcctcccttaccgcctgacaataaaaaaaggcccttatccagtgaagaataagagcctcttgtgtccaagtcagcggtttctattttttctcatattaaacccattattcccgtcagtcaagtgtgttattaaacccataccttcttttcgataataaaaataattattttataatcattataaaataatattgactttttactgataggtgatattatgttcttataaatttaaagaggtgatcacatgagttcaaataaactgacaaccagctggggcgctcctgtcggagataaccaaaactcaatgacggccggcgatcgcggtcctgctttaatacaagacgtccatctgcttgagaaattggcgcactttaacagagaacgcgttccggagcgtgtcgttcacgcaaaaggcgcgggcgcacacggttattttgaagtcacaaatgacgttacaaaatatacgaaagccgcatttctgtcagaagtcggtaaacgcacgccgcttttcatccgtttctcaaccgttgcgggcgaactgggctctagtgacacagtgcgcgacccgcgcggatttgccgttaaattttatacagaagaaggaaactacgatatcgtcggaaacaatacacccgtgttcttcatccgcgatgccatcaagttccctgactttatccatacacaaaaaagagatccgagaacacatctgaaaaatccgacggccgtttgggatttctggtctttgtcacccgaatccctgcaccaggtaaccattctgatgtcagaccggggcattccggcgactcttcgccatatgcacggattcggaagccatacatttaaatggacaaatgataaaggcgaaggcgtctggattaaatatcactttaaaacagagcaaggcgtgaaaaaccttgatgttaatacagccgcaaaaatcgcgggcgaaaatcccgattaccatacggaagatttgttcaatgcgattgaaaacggcgatttccccgcatggaaattatatgttcaaatcatgccgttagaagatgcaaacacatatcgctttgatccgtttgacgtcacaaaagtatggtctcaaaaagactatccgctgatcgaagtcggccgcatggttctgaaccgcaatccggaaaattactttgcggaagtagaacaggcgacgttctctcccggcacattagtgcccggcgtcgacgtctcacctgacaaaatgcttcaaggccggttgttcgcataccatgacgcgcatcgctaccgtgtcggcgcgaaccatcaggcgctgccgatcaaccgttcccgcaatgaagtgaaaaactatcagcgtgacggacaaatgcgttttgatgataacggcggccgctccgtctattacgagcctaacagcttcggcggcccgaaagagtcacctgaagataaacaggcggcataccctgtatcaggtttcgctgacagtgtaagctataatcatcatgatcattacacacaagccggcgacctgtaccgcctgatgagcgaggaagagcgcgcgcgccttgtcgccaatatcgtcagtgcgatgaaacctgtggaaaaagaagaaattaagctgcgccagatcggccacttctacaaggctgatcctgaatacggcagacgcgttgccgaaggactcggactgccgtcaccaaaataacatcaaaaaacctgccggtctgcccggcaggttttttatgttcattatcaataaaaccgtttttttctcaattacacgaagtggcatgccgcaaaatgatgaaaccctttttctgacagcgccggacttttctcagcacatatcttcttggctgccggacatctcgttcggaatttacagcctgaaggcggatcagaggggcttggtatatcaccctttaaaattatccgctcccttttcgctccgggatcaggaacaggcacggctgataacagcgctttcgtataagggtgaagcggccgtgaaaagagctcctcctttgacgcatattccacaatcgtccctaaatacataatggcgaccttcgtacataagtgctccaccacgcttaaatcatgagaaatgaacaagtatgacagcccgtgctgtttttgaaggctgctgaacaaattgatcatctgcgcctggatggagacatctaacgccgccacgggttcatccataatgataaattgcggtttgagcgccatcgctcttgcaatcacgatccgctgccgctgccctcctgaaaattcatgcggataacgatcgatgaagtttgcggaaagtccgcaggcttcaagaacctccgccgctttatcacgcgcattccgcttcaccgccaattgatgctcgatcatcgcttcaccgatggcttctccgatccggcgccggggatttaaagaactgaacggatcttgaaagatgagctgcgcttccgatctgaaagttttgagctcgcgccggctcatccgaaacacatcacgcccctgaaaaaacacctctccccctgttttctcatgaagcctcaaaatggtcttgccgattgatgactttccgctgcccgattctcccgctaagccgaacacttctccctttcctatcgtaaaactgacaccgtcaaccgcttttacgggttttttatgagtctttctcatccccccatgctcctcgtaatattttttcagccccttgacctccagcaacacatcactcatctgctttctcctctctgtaaagccagcacgccgcctgatgccccttcccgaattcagtaaaatgcgggctcgatctccggcatatttccgtgctgtgttcacatcgctccgcaaaataacaagacgatcccgacaggtccgcaagctcggggacctgccccggaatggtgtaaagcgtctcccttttttgaccgataaccggcttggccgcgagcagccctttcgtatacggatgcttcggatcagaaaacagctctgcaaccggtccttcctccacaatttttcccgcatacatgacaatcacataatcagccatttcagcaaccacgccaaggtcatgagtaatgaataaaatagacgtgcgaaattgctttttcatatcccgcaataaatccaatatttgcgcctgaatggttacgtcaagcgctgtcgtcggctcgtcggcaatgatcagtttcggatcgcagcttagcgcgacagccgtcatgatgcgttgcagcatgccgccgctcagctcatgaggatatcggtgcataacctgctcggcattcgggatctccactaacgtgatcagttcaacggctctccgccatgcctctttcttactcagcaacaaatgttcgcgaatcggttcggtcagctgctcaccgattgtaaacaccggattcaaagatgtcatcggttcctgaaaaatcatcccgatttcgcttccgcggattttctgcatgtcttttggtttcagttccaacaggttctgtccggaaaaatgcaccgctccccgttcgattctccccgtctcgggaataagctgcataatggacaatgacgccatacttttcccgcagccggactctcctacaatacaaaccgtttcctcctcatgtatcgtaaagctgactccgtccacggcctttaccgcaccctcctctgtataaaaagccgtttccaaatgccttacttctaaaagcggttttttcatttcattttcacctgccgttttaccttaggatcaaaagcgtctcttaaaccgtctccaagcaaatgaatcgccacaacggtcagaaaaatggccgttcccggcggaatccacagccacgggcggagtgtaaaatccataaaatgattcgccgcttccatcatgtttccccaagaaggtgtcggcggagcaacgccaagcccgagaaaactcagcgcagattcactcagcatcgctcccgccacatgcaaagtcgccgctaccagtaataacggcaatgtgttgggaagcaaatgatagaggattttccgtttatcactaagccccaaaacttccgcggccatcataaacagctgctccttcagcgacaaaatctgtccgcgtacaagccgcgccaaaccgggccatccgatcaggcttaacatcatcataatcaggtacattctgtattcagaaggcactttccactccgacatcaccgcagccaaaatcaaaagcagcggcaggcccgggatggacatgagcatatcagcaatgcgcataatgatcatatcagcggctccccgataaaacccggccgcagccccgagtaaagagccgatgacaagcgacagcaccattgaagcaagccccacggtcagagaaatctgccccgccagcatcagcctcgtcagcacatctctcccgtactggtcggtgcccagccagtgatggattcccggatgctgattggcatttgaaatatccgtccgatctgttatgtacggagaaaaagacggcccgataaagcacaataaaaacataaaatataagaaaagaagactgatgaccgtcagcttatgctgcagcaggcggcggtacgtctgcttccaaagagaaggcggcacctctttttgttttttcattccgaacaccccctatttcagtctgacccgcggatcaaccgcggcataagcgatatccgccaagaagttccctacaatcgttaaacaagacaaaaacaaggtaaacgccatcaaaaccggataatcacgataatgcacagattcaagctgaatacgtccgacacccggccacccgaaaatctgttcaataatgatggctccggaaaacagtcccggcagttcaaaagcaagcagggtgatggccggaataagcgcgtttttcaacgcatgtttccagatgacggtgcgctctttcaatcccttcgctctcgccgttctgatataatcctgtctgatcacgtccagcatgccggagcggaaataccttgtcagcgagccgatgccgagcatagataaaatcacgaccggaagaatcatatgtctggcggcttcaagcacgtacgaaaaacctgtactcgtgctgccggtatcaatcatcccgccgacgggcaatattttcaaatccaccccaaaccacttaataaacagaaggctgataaaaaaagacggaaacgccatggaagcaaaaacaagaaacgtcacgatcccgtcaaaccatgagtatttcctgacagcggatatgacacccgttatcatcgcggctgaccatgtaacaagcaacgccaaaaacgcgacaaaaaacgaattccagacatatttccgaagcagtgacaggacgttctcctgatatttcaaagaaaacccaaaatctccgctgagcacatttccgagccatgtcacataacgctgccaaatcggctgatccagcccgtaaagcgcttttaactccttcgctctttccggagtcaggtttacattggaatcaatatagtcgcccggcagcatggcgaataagaaaaaaataataaaggacgtaccgaataagatcacaagcatttgaatgaatcgttctgcggcataccgtttcataaaaagcccctcctttccgctgaaagggcaaaatccccaggatgcatcgggtattttgcccaaccgttctattgaattgagacatttgagagacttgaactgattccagaataattgtcagcctcaagcccttttatttttccgctgaccgcccttgcgctctgacggtaatgaatcagaatgtaaggcgggttttccccgagctcccggtacagctggtgataaatctcttttcttttgctgatatcaagcgtgccggctcctttctctatcagccggtccgctttcggattggaataccccgtcacattattgggatggccggaagccagcttttccaccgtgtcattcggatcaaggatctgcgaggtggaaacggcggcaaggtcatattgtttgtcattgattttcgctacttctgtattaaaatccatcacttccggttttaatgagattccgatgtccgcataattttctttcgctatcgggatgaaatcatcatccgctttagatgtgtaatagctgatttcaagctttttgccgtttttttcacgtacaccgtctttgcccgttttccagcctgcttcgtcaagaagctttttggctttttcagggttaaacgcataccgattgacacctttgtcatcataagcccacgaaaccggagacaccggaacattcgcgacctctccgtagcgtttaaagcggacatcgacgattttttgacggtcaagtccgtaaataagcgcctgggacactttcttatcttgaaaaggcggacgcttgtgattgacgtacacaagcccgtaatcattcacgacagatacgcttatattcgcaaaaccgagactttttaaatgctgaaccgtatcatcatcaggtgagaaagaagcgtaatcaaggtcacccgtttcaaacagctgaagggaagttgacggatcgataattttataaatcagcttttccgttttcggttttccggcataatagtgttcattagcctgatagcgtatttcctgtcccggaaggtattctgtaaattgataaggtcccgctccgagcggtttggcataaagctcttttaaatagtccagtttgccgaattgatatttcttcccgtagtaggcttctgacagcacctgcccgcccaaaagaagcagcgacttcgcactgactttctcagtcgtgatttgaatggttctgtcatcaaggacgcgaatgccctctatcgtctttgcctttccttctttgtaagccttaccgcctttaatataagccgtggtgatatcttcatagcccgcgtatgcaggatcatgcagcagtgttaaagtgaatgcggcatcctttgcggtcagcggtgaaccgtcgctgaaaacgagattttttcttaaacggaacgtgtatgtaagctgatctttggaaattttccagctttccgcaagagccggggcaggcttccccgttttatccagtttgactaacggttcaaaaataggatctgtcgcatttccatcccagccgttttcgtaaaagtacggcagaaacacgccgcccggcgcggaaatcccagcaacaaaagtgtcagttctggctttcgatttagcgggaatcgccgccggatgagaagctttaaattcctttgtcttgacatgggtgatacgtgtttcttcctttttatcagccgcagatgacggttcttccccggcactccctaacgcgcaccctgataacatgatggataccgacagcgcgagtaccgttgttttcaacctccattttctctccttcatctttatcgaacccccgcatgcttttcatctatctttatataaatctgctccatctgttcctcatttctcataatctcccgtttgtttttctctacaagcagttcgaaattcaatgtgtgttttctgtactttttccgcttttttctctttttgcgcacatgtgataccttttttaacgccacttttcatccctccgcttttcatttaatgactttcacgcaaaaaaggcccttatctgtttaatagataagagccttcggtgatccgatcagccatcgtttggaaatatgtaatgattatgttaattcatacaatccctacctgtcaactacaatttaaaatatcgtgtccttccgggggttttcctcatacactctctcatttttccgcatatgctagaaaacatagcagattacaagtgaaagtgagtgagaatgtggaaaagacaacattgagcggtcgcatcgtcaaaaaagatgacccggactataatgccgcaagaaccaatttcaatttaagcctgcaaagatatccagacatcattgtgttttgccaaaacaaacatgacgccctcaatgcggtgagatgggcacgtgagaacaatgtgcctttccgtatcagaggcggaagacacagctacgaaaatttttccctgttaaatgacggactagtcattgatctcagtgaaatgaagaaaataagagtaaatgaggataagcggctggtctcgattgaagcgggagccgaattaggggaagtctaccggacactctggcggtacggcttgacccttcctgcgggaaccattgcgaatgtgggaatcacggggctgacgctcggggaggaatcggatatttaacaaggactgccggacttacttgcgatcgtctcctccagctcgaaatgatcatagcggacgaaaaagcgggtgctgacttgatcacagtcaaccgctcaaagcactctgatctattttgggcatctcagggcggagggggaggcaacttcggcattgtcacatccatgatgtttaaagccgtgccgatctcgtgcgtgtctgttttttctgtcacttggggctgggatgatttcgaggaagtatttaatacgtggcagcgctgggctccatttacagacaaccggcttacctcatcaattcagttttggcctaaggaagtcaaccgcatagaagcactcggtcaatttaccgggacaaaagaggagctgaaagaactgctggctccgttaatgaaagcgggaaaaccgacaagcggcatggtcaagacagtgccatttattaaagcagcagccttttttaacagcccgggaggcaatcagccgcaaaagatgaagcggtcaggatcctttattgaaaaaccattatcaacacgcgcaatatccactttaaagcgctatttagagcacgctccgaacgaaaacgccagtgtctggcagcaatctctcggcggggcggccggacggatcgctccggaccaaacggcattctactatcgcaacgcaatcattgcccaagaatatattacaacttggacatctgctgaagaagaaagacaaaatgtccgctggatcgaaggactgagaacgtccctatcaagagaaacgatgggagattatgtgaattggcctgatagagaaatcagaaactggctgcaaacgtattacggagaaaatgttcaccgcctccgtcaagtcaaaacgaaatatgatccggaaaatatattccgcttcgagcagagcattccgccgcttcgccgttcaccgtttttctaaaaaagatgaagatggatacactccatcttcatcttttcttttattgatataagcggcttcccttctctgcaaactcttttgctttttctttcagcccttcattgacggcctcgtcttcagtaagtccgttttccttcgcataatcacgaatatcctgagaaattctcatgctgcagaacttcgggccgcacatcgaacagaagtgagccgtttttgcgccttcagccggcagcgtttcatcatgatattccattgctctttcaggatcaagcgacaaatgaaattgatcacgccaccggaattcaaaccgcgccttagacagagcatcgtcacggatctgtgcacccggatgccctttagcaaggtctgcggcatgtgccgcgattttgtacgtaatgacgccttctcttacatcatcacgattcggcagccccaaatgctccttcggcgtgacatagcaaagcatcgccgtcccgtaccagccgatcatcgccgcgccgattgctgaagtaatgtggtcatagcccggagcgatatccgtcgttaatgggccgagcgtgtaaaaaggcgcctctttacaaatttccagctgcttgtccatgttttccttaattttatgcatcggcacatgacccggtccttcgatcatcacttgcacatcgtgcttccacgcaatctccgtcaattctccgagagtctccaattccgcaaactgcgcttcatcattggcatccgcaatcgaacccggacgaagcccgtcaccaagtgaaaaagcgatatcatagctcttcatgatttcacaaatttcttcaaaatgcgtgtacagaaagctttcctgatgatgagccaggcaccattgcgccataatcgccccgccgcgggatacgattcccgtcgtgcgtttagccgttaacgggacataacgaagcagtacgccggcatgaatggtgaaataatccacgccctgctccgcctgctcaatcaatgtgtcacgataaatgtcccacgttaaatcctcggcaatgccattaactttttcaagcgcctgataaatcggcaccgtccccacaggcacggggcagttgcggataatccattcacgcgtcgtatgaatgtcttttcccgtggataaatccatcatcgtatcagcgccccagcgaatcgcccacgtcattttttcgacttcttcttcgatagaagatgtaacagccgagttgccgatattggcattaattttcacatgaaaattccggccgataatcatcggctcgctttccgggtggttgacgttagaaggaataatcgcccggccgctggctacctcgtctctgacaaattcgggagacacatgctcgcgaattgcgataaactccatttccggcgtaatgatgccttttctcgcataatgcaattgtgttacatttttccccggcttggcccgaagcggtttccgctgcaggccggggtattcggcagcatgatcttcttttttatagccgttgtcttcaggtctcacggtccggccgttatattcttctacttctccgcgcccggtaatccactttgtgcggagcgcccccagaccttcatgaatatcaatctgtacatccgggtctgtatacggtccgctcgtatcataaacacggaccggcgcattctcctcttccccgaatgcccccgtagtcgcactcaggctgatttcccgcatcggcactcgtatgtcgggcgaagaaccttctgcataaacctttttactgccggaaaaactcgacataatggaaatgttcgcttgctgtactgattgattttgcatacaaatctctcctttatcatttgaataacagaaccaagctcagcaccagcacaaaaaaaccgggttcaaagaagaacccggttttgcagtcagaaagaaactattattgttttcctcaacaataataaaacctttacttccccacgctggtacgaaccagatcaggtccaaagggttaagaagccgccgcttctctctcagcccgctcagacgggcacccccagtaactattgatttcgctctcatcgtaacataagttgtgtacaaaaaaaagcatattatcaaaattcagataacggaatggtcataagctctgtttcccgaacgccttcttcggtattaaaaacccgataaccctttgcggtttcccgggaagagacagcccggaacagctgaccgtctttataatgaagcgcagcgccgtcatcagcggcatagccctccctgagtatcttttcggaaatcagacggtgatacaccggccggcgctccgcttctccgtcatagtgcggacaaaagctgcccggcaaaaatcctaaagctgttaactctcgcaaatcccccgctgaatccgtcaccccttcttcataccagcaaatcgctccggcgctgagacccgctaagatgatgccgttttcccaagcctcacgaagaataaggtcaagcccccactctttccataagacaagcatattgcgcgtatttccgccgccgacatatataatatctttcttcatgagaaaggatctgagatcagaacccggcggtttaaacagcgacaagtgatccggctcacaccgcagcttttgaaaggcctgataaaacctgccggtatatttctccgaatctccgcttgccgtcggcaaaaaacaaactttcggctttgaccgcgccgactgctctaaaatatactgatccagcacaagatgatccggctccatggaaaaccccccgccgcccattgcaataatctgcttcaatgtcatcacttctttttttctcaagtataacagctcattaaaaaggcgttatctcaatttcggataacgccttcaaaaagtatttgttatctgaaaaatacgcaccgtataacacaacggagatccccgcggcgttaatcgccggaacaagcttcgaacgggcatacttcgcaacattgatccccaacaccgtattatcactgaggggagaagcaaaccaaatgttccgctcgctaataataagctggtatgtaactgaaccgccagcgttacgccgagcgccccaagtccccaggatgacccgataaaatgggatataacagcccccagtataaaaagagacggcgcaataaacatatgagggctccatgatgttaaatgagaagtaacatatttcgagaatcccagattttcagctactgctgttacggcccaaatcagcgataacataataataacgttgaccaattcgtttccgcccttaataaaatgggtaacaagctcgcctgcaggaaagcgctgaaacataaaaagagcaaatactgcaataaccgctgccaataatgcgcgcttttgaatggccgccccaccagctgagaaacagtgttaatagcaaaaacagcccgatcggaaagatttaactccacggccgaatcggtgtttccttaatataagcacggtgcgccgaatccagctcctcctactgcaggtatcatgttttcacaagccttggagatattttcatacaacaaaaaaggcttctacaatatgtagaagcctttgtataccggtggccggggtcgaaccggcactccagaaggaacacgattttgagtcgtgcgcgtctgccaattccgccacaccggcatataatgcgtcgtgttcaaccgacgtatataaatataacatgcattctataaagagtcaatggttttagtaaagttttttcaaatggtaatgcagtatatacgatacaagcaagaaacttatattgatagtcttcacgcttttattatataaaaaaagcgacctgcaatatgcaaatcactctcatatatgttttataataagaaaattgatgaccaatttaacataattcgctcaaagttaaattggtgccgagggccggacttgaaccggcacggtagtcacctaccgcaggattttaagtcctgtgtgtctgccaattccaccaccccggcaatagaaaggcgacacccggattcgaaccggggataaaggttttgcagacctctgccttaccacttggctatgccgccgtaatttggagcggaagacgggattcgaacccgcgacccccaccttggcaaggtgatgttctaccactgaactacttccgcaacatgtaaaagaacttaatacatcttatgctgttgttttcaaaaaaatgcaactgggctagctggattcgaaccaacgcatgacggagtcaaagtccgttgccttaccgcttggctatagcccaatgataatatggggcgattgatgggaatcgaacccacgagtgccagagccacaatctggtgcgttaaccacttcgccacaaccgccataatctgaagatgaataaataatatagtggcaggggcagtaggaatcgaacccacaccggaggttttggagacctctgttctaccgttaaactatgcccctatttataaaatggtggaggggggcagattcgaactgccgaaccctgagggagcggatttacagtccgccgcgtttagccacttcgctacccctccatcatttagagtgccggccagaggacttgaacccccaacctactgattacaagtcagttgctctaccaattgagctagaccggcaaatggtggctcgggacggaatcgaaccgccgacacacggattttcagtccgttgctctaccaactgagctaccgagcctttttataaatggcggtccggacgggactcgaacccgcgacctcctgcgtgacaggcaggcattctaaccaactgaactaccggaccatttttttggttgcgggggcaggatttgaacctgcgaccttcgggttatgagcccgacgagctaccgaactgctccaccccgcgatgataatggtggaggatgacgggctcgaaccgccgaccctctgcttgtaaggcagatgctctcccagctgagctaatcctccatcatataagtgacccgtacgggattcgaacccgtgttaccgccgtgaaagggcggtgtcttaaccgcttgaccaacgggccctggtattttttcgtttgttatgtattgataattagtggcggagagcaagggattcgaacccttgagacggggttaccgcctacacgatttccaatcgtgctccttcggccactcggacagctctccataattggctccgcaggtaggattcgaacctacgaccgatcggttaacagccgatagctctaccactgagctactgcggaatgaagtctgcctggcgatgtcctactctcacagggggaaacccccgactaccatcggcgctgaagagcttaacttccgtgttcggcatgggaacgggtgtgacctcttcgccatcatcaccagacgttttagtgacatgtattattatactatgtatttcggaaaaagcaagagtttttttaaaaaattctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtcccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacgcataggacatgctaacacatgcgttgccacaggaagtggcgcatttagcaggtgttcctatgttttgaaggaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcatctcaacctcatctcgaggcgactttttcagtataacatttcagcgatttgctgtcaaatgtttttttgtttttatttctccgccgctgtgagctttttggtgaagcgcatcagcgacgtttaataatataccatgcctatgattcagcgtcaacactttttttgaaagaatatcctcgatgatatacttcctgccctttggtctctatttgagatacttcaacaaagcctttttccgtcaggtaatcaagcatgacaccgagatcttgggtgaagtgcaccagttcagggtgctgaagcaattctccaaactgccacatttctttttctttcatcacctgaaaaaggtgcgcagaaccgatttcagcttttgaatggatgagaaaatcatttgctaagaataataattcgagccttttctccaagctttcgtgactctcgacaagttcggaatatagcttatatacctgcggctcaatgtgacggacctggttccagactgtcgtttcgggataaaacccccggtcaatcacttctatgcgggccaagtggtgaagagcgtgcactaccgcataatatgcatccagaaaatgatcagcttcaaaaaacgcttttccttctacaaatcttctgatcagcttgccgtattccattccgatctttaatttccgctcggcgaaaggaaaagtgctgagccggtcattgagttcagatatatattcattgcggtcaaacagcactttgccgttgatgatccaatctatgactcttctatttgtcccaagcagaatccattcctgaagcagagcatccgttacaatatgtaaagaagcggttttgtgttcgaattcataatgctttataaaaagaggttcatcagcctgtttcacaatgacaagcatgaccgcatcaaagttatccgtgatggatgatgctttactccttctctcaatcataaggacggccagcgtatcgggatgacttgctctttcttggtaaattggacggagaagattgtccattacgattcctccaatgcgattgtttcactagctattgtttctacatttctatgataaaacatgaaagtccttttttctaaacacattgcactattataacaaatttcctttcaggtgccatatttattcttcccttttcttacgaaaacatgaagaatatgccatatgttttgtgctatagttaaacgagagggggatggacatggcgaaatactcaagcaaaattaataagatcagaacgtttgcgttaagtttggttttcgttgggtttatcattatgtacatcgggctgttctttaagcagtctgttttgcttgccagcttgtttatgattctcggcctgctgtcgatcggactcagcaccgccgtttatttttggatcggcatgctgtccacaaaagcggtccgggtgatgtgccccgcttgcgagaaagaaacgaagattctgggcagagtggatatgtgcatgcattgcagagagccgcttacattggataaaggattggaaggcaaagcgttcgatgagtcttataacagaaaaaacagtgtaaaataaacgaagctgaccgtatcaaagcggtcagcttcgtttagtggttttcttttttggaacattcttggcagacgccgtaaatctccaaacggtggtggcttaccttaaaccctgtgacgtgagcagcaagctgttccacttcgtcaagcccgggataatggaagtccacgatttttccgcagctttcacaaatggcgtgataatggtcagaggtgacaaagtcaaatctgctggacgcatctccgtacgtcagttcctttacaagccccgcttcccggaatacacgcaaattgttatacactgtcgcaacactcatattagggaatttcccttccaaggctttatatatatcgtccgctgtcggatgtgccatagaatccacgagatattccagaatggcatgacgttgaggagtaatccggactcccgtatccttcaacgtgtctaaggcttcttttaattcatgtgcagccatccgtcatgcacctctcttctaaaaaagattcttactttataatgtttataattagtgtacatctttttccggtctcctgtcaaatgtaatctgaagaaaaccccgtgagttcagcatttgtccattaattagacgcaatttgttccaattcacgaagcgcctcggcaacgtgatctttcacttttacctttctccactccttcacaagacggccttctttgtctaacaaaaaagtggatcgctcgatacccatatattctttcccaaaattcttcttcagcttccacacatcaaaagcttccgccagtttgtgctcatcatcaacgaggagctggaaaggaagatcgtgtttttgcttaaatttttcatgtttatcacggctgtcagggcttactccgatgataaccgcatcaagtcccgcgaaactttcgtgctgatcacggaaatcacatgcttccgtcgtgcatccgggtgtcatgtctttcggataaaaatagagaacgacgtacttccctttaaaatccgtcaatgctacttcttccccgctgtcattcactaatttcatatccggtgctgtttgtccgatttcaatcgtcatttcttatacctccgggttttttattaagcgtatccaattcacgttaagattacaaccgttatcccccggctcttttctggaagcatgaacccgttgtgctcgcaatgaagcatgctacaatagaacatgatgtaaggagatattaggagggtcattttttgtatacaaaatcagttgaacttcataaggaagcgttagagcatatcgtcggaggcgtgaacagcccgtccagatcctataaagcggtaggcggcggttcacccgttgcgatggaaaaagcgaacggcgcttatttctgggatgtagacgggaatcagtatatcgattatttagcggcttacggtccgattattaccggacatgcccatccgcatattactgaagcgattaaaacagcggcggaaaacggcgtgctgtacgggacgccgaccaaacatgaggtcactttcgccaaaatgctgaaggaggccattccttcacttgataaagtacgattcgtaaactcaggcactgaagcggtgatgacaacgatccgggttgcacgcgcttatacaggccgcacaaaaatcattaaattcgccggctgctatcacggccattctgatctcgtacttgtcgctgcgggttccggcccgtctacgctcggcacccctgattccgccggcgtgccgaaaagcatcgccaatgaggtcattaccgttcctttcaatgatattgaaagctacaaagccgcgctggataaatggggttcagaaattgcagcggttctcgtcgagccgatcgtcggcaacttcggcatcgttgaacctgaagaaggatttttagaacaggtaaatgaattgacccataaagcgggcgcgctcgtcatttatgatgaagtgatcacggcgttccgttttatgtacggaggcgcgcaggatcttcttcaagtgaagcctgatttaacggcgctcggtaaaattatcgggggcggcttgccgatcggcgcttacggaggcaaaaaagagatcatggagcaggttgctccgctcggcccggcatatcaagccggcacgatggccggaaacccggcatctatcctatcaggcatcgcctgcctggaagtgctgaaggaagaaggcgtttacgagcggcttgatgagctcggcgccagacttgagcaaggcattctcgcccatgcggagacacatggcattaccatcaccgtcaaccgtttaaaaggcgcgctcacggtttacttcactgatgaaaaaatcgtcaattacgagcaggcggaaaatacggacggagaagcattcgccaagttcttcaagctgatgcttgaacgcggcatcaatctcgctccgtcgaagtatgaagcttggtttatcacaaccgcacatactgaagaggatatcgacgccactttacaagccgttgaagatgcgttcagacatatgaaaaaataacttctgaaacaagcgggagcccggggcttccgctttttctttttgtccgatttgtgagataatggttttttcaaaaaaagaccttgaataattggtatgatccctgtatattactttattgtttagcaaatcagccgacagggaaatgtaagtgtcagccgttcgttcggcacataatttattagagaaaggaatgcacgcacaaaccaatgaaacttggtgcccgcatttttaaaacagggattgcgattacgctcgcgctctacttagcatcatggatcggacttccgtcgccgatctttgccgggattgcagctatatttgccatacagccctctatttacaggtcttttcttatcattattgatcaggttcaggcaaatatcatcggcgctgtcatcgctacggtattcggactgattttcggaccgagtccgattatgatcggattgaccgcagtgattgtcatcacgatcatgttaaaactgaaaattgaacacaccatttcgattgcgctcgtgacggttatcgcgattttagaaacaccgggaaacagcttcctgacgttcgctctgatacgaacaagcaccgttattttaggcgtgctgtcttcttttattgtgaaccttgtgtttcttccgccgaaatacgaaacgaagctgactcatcatacggttgaatataccgatgagatcatgaaatggatcaggctgacgatgcgtcagtctacggaacactcgatattgaaagaggatattgagaagctgaaggaaaaaatgatgaagcttgatcatacgtaccttctttataaagaggagagaagctactttaagaaaacgacgtatgtaaagtcgcgcaagcttgttttattcagacaggcgattattacggcaaatcgggcgcttgatacgctgaaaaagctgcaccgctatgaaaacgagatttatcatatgccggaggaatttcaggagacgctgacagaagaaattgattatctgcttcattggcacgaaaggattctgatgcggacggtcggcaagatcaaaccgcatgatgacgatgctgaagaaagcataagatataaacagcttttgacgaagtctttcttgaaaaatcagcagaactgcgaggatgaactgcttgattacaatatgctcagcattatggctgcggttgcggaataccgcgagcagctggagcatctcgatacgctaattacgagttttcagacataccacccgaaagacagcgaattagaaacagacgaagagtaacccggtgcttccgtaaaaccgggtttttttgcattcaaaaaacgtatgccgcccattcggacggcatacgtttttgtatcagttcaaattctgaatcgtaaataagtgtctgtactggccgccttgggccattaattcctcgtgcgtgccggtttcgacgacggcgccgttttccatgacgacaattttatccgcgtgcgtaatcgtggacagtctgtgggcgacgataaaagtcgtccggtttttcgcaagcttttccatcgcttcctgaatgtagtgttcactttcaagatcaagagccgatgtcgcttcatccaagatcagcagcggcggattttttaagaatacacgggcgatcgaaatccgctgcttctgcccgcctgacaatttgacgccccgttcgccgactttggtttcgtagccttcggggaagttcataataaattcatgggcatttgccgctttcgcagccgcaaccacctcatccagagacgctcccggtttaccgatagcgatattttcacgaatcgtctcactgaacagaaacgtatcctgaagcaccattccgacttgattgcggaggcttctcgcttcataatcgcgaatatctgtgccgtcaatcagcaggctgccgccggatacatcataaaaacgcggtatgaggctgacaagcgtcgattttccgccgccgctcatcccgacgagcgcgacggtttccccttttgtcacctttaaggaaacgtcctgcaaaatcgtttcttttccttcctcataacggaacgagacatttcggaattcaacttcacccttaatgccgtcagcttttaatgcattcggtttatcagtcagttcatacggctcgtcgataaattcaaatatgcgatccattgaagcgatcgactgggtcagcgtcgtcgatgagttgatcaatcttctgaccggattgtacattctgtcaatatagccgacgaacgcaaccatcgtccctaccgtcagcgggccgtttatgacaaaataacccgcaaacgcgataacaagcagcggcgccaaatccgtaatggtattcacaactgcgaacgttttcgcgttccaattcgtatgacggatcgctttgtccagaaaatgtccgtttttttcatcaaaattggcttgttcataatcttcaatggcgaaacttctgataacgggcatcccctgaactctttcgtgcaaatgtccctgaacttgggcgagtgcctgagaacgctcacgtgtcagttttcggagacggccgtaaaagtatttcactgaaattccgtataacggaaacaaaatgacagatatcaatgtcagcttcacatcgagtgtaaacataatacagatgacgatcagcaccgtcatcatatcaagccagatattcatcagtcccgttatgacaaagtcttttgtctgttcgacatcatttatcacccgggaaatgacttcgcccgttctcgtgttggcataaaacctcaggctcaatttctgaatatgatcaaacaataccccctgatatcgtagagcacccggctgcccgtccattgtgcgaagtattgccgatagtactctaccgggggacgcagaattaaaaacagcacgaacatgatgcccattatcgtgaatagcgatgatgttttagcgcttgccgttccgctcccttgaataatgtcatcgaccacgtattttaacagaagcgggagagccagcgggatggagaattttataatgccgattaacactgtgataaaaatttgttttttataaggttttacaaattgcatatagcgtctgattacgcccacactttatccccctctctctttaaggcgtgtgagcccatgtgaaaaacctgttgacaccccaacaggttttttattgtattctttattttgtatagcgcagataccgttcataccacatatcaacaaattccggagcaaacggtcctttccgctgatgaatccaatgcagcagcgtattcagatactccttcagaatgctgtcgatctctttagggtaattcattgatttgcggtggtcatcgtattcatcctcgtcaagaatgttatacgtcatatccggaaacaccttgacatccaaatcgtaatcaatatatttgatggcctctccgtcataagcgaacggcgagctgatgttgcaataatagtgtaccccgtcatctctcagcattccgatgacgttaaaccactgacgggcatgaaagtagcagatcgccggctctctcgtcacccacgtccgtccgtcggattccgtcaccattgtccggtcgttggctccgatgatacacaattccgtactttttaaaatcgtcgtttcattccaaattcgatgaagcagcccgttatgcttatagctgtgaatttgaatggtttctccttccttgggatatcccatatttctcccctactttctgtaaagccctgcagtcaatgcagccgcaattgctttccgacaagtcttttcactattataacgttacgaattaaaaaatgaaaataaaagaaccactccgcttccggaatggcacattcatttctgcacataggaagacggcttttccgtgctgcgataagactggatgacttgctctgtctgcctttggaataactcctgtatgccggccaggtcttttcgctttgtcgcaatttcgtcctgtacattgtccagctttgcatctctttccagactgatgagttccgcttccacctgccggcagcggtcaagttctgactgcagctcgagaagctgatccatgattttcatctgttcacttacaagcttttcaaactctgacatcgggttcctccttaggctttaggttgatactccttaccatttcgattttacgccggaaaaccctttgactcattctgtagaggaatcacaagttttgtcgttttagcaacagaaaaaagcacttccatccgaagatgaagtgctttttcgtttcagtgattagctgttttgctgtttgttttgttcagcagattggttttgctttctaacctgctgcgcatcagtttcactgccgaattcagtgccgtattgaccctgaccggaagctgattgctggttttgtcttttcacctgctgaacgtctgttttgctgtattttgagtttgccattgttatcacctccacgcactttagaatgcgcaggagacgataaggctattcatctttttttaaaacttatacgagcagagagcgtccgccgtcaataatgatggtctggccgcggatcatgtccgcttttgaagaaactaaaaactccaccgtgtcgatcatatctttaatctcgaccattctgccggccggcgtattttggcgggcatcttccagcagttcatctctgttagggaaatgcttcagcgcgtccgtatcaatcgctccgcctgacaccgcgtttacgatgatgtttttcggagaaagctcaaccgccagataacgggttaacgattctaaagcggcttttgagacaccgaccgtcgtatagttttcaagatagcggatgctgccgagcgagctgatgctgacgatgtggccgcctccgtttttctccatcatctttgccgcttcctgggcgcagaaaagcaatgctttcgcgttgatattcatcgtccagtcccagtgtgtttcttcgagttccataaccggtctcagcacgcctgaagccgcattattgacgaacacgtccagtctgccgaatgtttcgtcaatctggcggaacatgtctttgatttttgccggctggccgacattagctttaataacgagcgttttaacgccgagtttttcaatttcttcggcggtttctaatgccgcttttttactgcgggcgtaattgatgacgatattgtatcctttttccgcgagtctgatggcggctgctttcccgacgcctcggctgcttcccgtgatcagtgcgcatttattttgttccatttttcctcagctccttgctgtgtatagttcttttcattcaacaaacaataaaagcaatatctgttgaaaggggtcttttatatgtatgtcggacgtgatatgggcgaattggccatgatgcccaaacaagattggagagattcagagctcgcctatttccatcatgccttccagcaaattatgccgtatttaaacgaagaaggccagtccaaataccgggaactgattcaggaaatcgaagcccgcggcggactgaaacggaatgaagcggattacggccacggcactcgcgtcagctatgactgacgctttttagcggccgctttcttccgccattttccatatcttttgatgggaaacgggaaatgcgtattccttgagctcctcttttgtgacccgtatgaattccgttgtatccgacacttgttttactttaccgaaaaagaccgaaatattccagacgagatgggtgaaaacatgttctacgatgccttccagctccccgatttcagcggttattcccatctctttttctaaataggcttcaagctgctctctttcggttttgattcctttctgggtttcggtattcggaaactcccacaagttggcgagcaagccttttggcggccgtttatgaatatagacatcgccttgttcgtctgtcagcacaacggctgccattgtttttattccgggctttttctttttgcttttaacgggcagctcccgctctgtcccttccgcaaatgccgaacagtgcttttgtacggggcaaagcaggcatgacggtgatttcggggtgcagatgatcgcgccgagctccattaaaccctgattgaattcagatggtttttcatgagaaatgaaagcggataccgcctgttcgaaaatggttctggttttaggttttgcgatatcgtcccatatggaaagaattctcgacatgacacgcatcacattgccgtctacggcgggaatcggtttgttgtatgcgatgctgagcacggcgccttttgtataagggccgacgcctttcagtccgccaaattccttttccccggcagggacgactcccccgtaccgctcatgtacttcttttacggcactttgcagatttcttacacgggagtaataacctagcccttcccaggctttgagcactttttcctcatcggcttcagcgagcgccgaaacggtcggaaattgctcaacaaaccgccggaaataaggaatgacggtatctacgcgcgtctgctgcagcatcacctctgacacccacacccgatacgggtcctgattttctctccacggcagaattctctgttctctttcgaaccatgtaattaagtcctcgcgaaatttgtctatatctttttgtttcattttttcttcaagtgcgttcatatcttctcctcagatgtttcgggttccgcttttcttgacactgtattttggtgtaaactaagggcacgttacgataatatgttacattaaatagtgataaagaaaaagcggaaacatatgagaacggcggataaacgccatgattgggcaaacagaaaatggggaatatcttataatgcgaaatatgcgggcggctgatttttaacgcctgctaggaggtcaacaatggatactggcactcacgttgtcatgggtatcgcgcttggcggaatcgcaactcttgatcctgccgtcggcatgcacaccccaatgtctcaggcagttatgatcgccgcgcttgccggctctcaggcacctgatattgataccatattgaagctgaaaaataatgccgtttatattcgaaatcatagaggattcacgcactccattcccgccgtattattttggtccgttctgattccgggcattttgtttatgttttatccggaagcgaactttttgcacctgtggctgtggacgcttctggctgtcgttttgcatgtgtttgttgacatttttaacgcgtacggcacacaggccatccgcccgttttcgagaaaatggatcgctctcggtttaatcaatacctttgatccgtttattttcgtcagccatttggccgcgattgccgtttggtatatcggaggtcatccgggcgtgacatttctgatgctttatatcatccttgcaggatattacgccgtccggtttttgatgcagctgcggataaagcgaaggctgcgcgaaatgattgaagaggagattgaaaccatcattatttcgccgacgatgaaattcaggcagtggcgtatcgccgtgacgacggcccatgccttttatgtcggcagaagccttgacggccatgtcgtgatattggatacattcaaccgcgtgcccgttccggaaaccgatgtgatgaaggccgcgaaacaggacgaaaatattgcagcctttctttcattttcccccgtttacaggtgggaggtcgatacttttaaagatcattatgaggtgcgctttattgatttgcgctaccggagcaaaggccactatccttttgtcgccatcgtccacctcagtcatgatttagagcttctctcttcctacacgggctggattttcagcgaggaaaaactgcagaaaaaattaaagctcggctctgtttaagagccgggctttttttgtcttctcacatataatgcggcaaacacgaggctgatcaccgatagagcggccgcgggtttaaaaaacggcgggtaatacgttaattgaatatcgttttttcctttttgcgctttaaatccgataaaggaataatccgctttttcaatctgttcttttctgccgtttatcttcagctcccagcctttttcatatggaatcggaagcatgatatacggcgcgctggttttgttttcatacgagatatgaagcgtatttccgcgccatctgagatcggcccgcggttctttttccgcttttcggtatgcgtttttcagcgtatcgtaccgttcttcgtaaagcgccagcctgtcaagctgatacgatcctttcggcagacggatttggatgttttttgttttcggcactctgacagtaagatcgttgacacctgttttgtaaatggattgattcgattttctcgttgtcgtgtaatcgttcacttttaatgtaaagccctggtccttcgctttattcttcaaataaaagctgacgtaataatcgccgccgtccatcttagcggcttgcggcgtaatgatcaggccgccgccgtcttcatttaccgtcaggatgccgtcttgataatccgcatggtcggccgttacctttgcctgacggatcatatttttcgcctcaggcgcttttttcgtgttggctgcgcttgattccgtgatgatcccgtcaagcattgcccgttctctggcaagggagggcgcttttttcagaccgtcctcgttatatacgcgatcagctgtccgtacgaacggaagcatatattgattttgataaaccgcataatgggatgattccatgatttttttgaacccgtacggcacgccggccccgtttgttttttccgtcatataatattttccgtaaagcaggctgtataaattagccctgtttcctaatgtcgcataacggctgacgctttccctgcccatgtcaatccggaggtcgttccagtaaaaggacagcagattgcggttcagtatgcttgaatatacgctgaatccgttgaacccgtatatgatcggagtgttattgaaaacaccgttcatccaatccaaacgggcaaacggatcagggtctttttctttcaggcgctgaataagctctgtttgttctttgcccttatagtcaggacccgtcataaaggtatgcgataccgtataaatcttcccgccttctgataacgcatatttttcatatgtattagccgtcagcaccgccgtcaagagaatgacggcatagacggcggacaccgcgcctttcagtcttgtctttgctgcaaggaaagcggcaatggtcagccccagaaggagcaggataggcaggttggcctgatcagaaatatccaggctgaaccgtctcacttggctccaatagagcagaacggcgagtacggcggatatcagcatactcttcatgctgatgtctgaaagcttagaaagccctgctgcaaccgttccggcaatcgtgaagcacaggacgtattcaaacctgttttgcggagctgaaaaaccgttaaaggcgcttgccgcaaacggactgaagtgaaacagaatgtacagcagactgattcccgcaaacagccggaacagccggtttttatataaagaaaatgtaaatagaaaaagtaaaaaaaccgccggcagaatgattatccggcttgaaaataaaatgttgtcggaaaaatcaagccatgcaatttgctctgaatacggcggccgcagattatgaagatatccgtatacgacagggataaaggaaactgcgcttatgccgaacccgagaaggcccgacagaataaatatcctgcattgagcgagccttttcgcctcattgccttcaagggggatcatccacctgaataagatataaatgccgatgaaaatcagattaatatacgcaaaataaaagttgttgatcaatgtcagcgcacaggcgaagataaaccacgccggctttttttccctgatgattttttccgcgccgagcacgagcagcggcagccacaccatactgtcagtgaaaaagtcccaatacacctcatgccggaagtagataatcgagaccccgtacaacacggcgccggcaaaagcaggcaccgtccgtttgacgaaatagcggaacacacacgccgccgtgaatatgatgaaactctgcttggcgatgctgataaaaacggaggcctgcgcccaaaacagcgcatcagcctcacccgtcagctgaataagctgcaaaaagcggacagcggcggagataaacaggaatagaaaagaagtagagaaataatagccgagctgactgtacactcccccgcccagtccgaacgaatagctgtaaaacagcctgccgttcatatattgatcaaacagcagctttttgaagaccgccatttgggcgatcccgtctccagaccccgtcatatagcggccttccgaccactcttttaagaaaaaaatatgagcggctgccgcagccagcacacaggctgccggcaagatccatttattttttttcatacaacgtccccagaccctgcgcacagcggcggctgtttaatggttccacttgcgcttttttgtataattcgtttcattttgttctccgtacgttatattcgcttctttaattaaatagtgcgggcgtttttttgtttcatagtaaatccggccgatgtattctccgatgatgccgagactcaaaagctggatgccccctaaaaacagcacggcggaaataatggtgaagtatccgggtacggacacgccgtgtgtcagaatatgaacaaaggtcgttacaatataaaccatcgacagaagcaatatcagaataccggtgaaaaagcataccctgaggggcttgttgttgaaggagacgacaccgtccattccgtagttgaacagattgctgaatgaccatttggacgtgccgttcttcctttcgacattttcataaaatacgattttctggtcaaacccgatccagcagaacagccctttcgagaaacggttcccttcactcagcttcaaaagggcatcaacggcctgccggctcagcaggcggaaatctccgaccccgtcacgcaagtccacttcgacggctttgttgataaatttataatacagggaagaaagcacggaacgcacggggctgtccccttttcggttgcgctgcgcgatgacttggtcatacccttcttcatagccttgaatgaagtctttcagcagatgggtcggatgctgcagatcggcgtccatcacgattaccgcttcgccctgcacgtgttcaaatcctgccaaaatggccgcttctttcccgaagttgcgggaaaaagatatgtatttgacgcgatggtttctggcggccagttctttaatctgctgaagggtgtcatccgcgcttccgtcattgatgtagaaaatttcatagtcataatgaatcgtctgaaattctttttttaaagattcatggatgagcttgacgttgttcccttcattgtaagacggaataataattgagattaacctttgtttcatgaaggcaccttctttgtattattctttttttaggacggccttaaaggaattgtccgcaaaacttcagtaaggcttttcctttttttaatgacgtttaaaccctttttttgttacagggaaagaaatttttttctgcatatgatttatattttgtcatgtttttcggcagatatgagaaaaaaaagaaaaagtctgtacgcgggacagactttattgctgaaggtattcatgaatcaaatggctgacgatgcgcggtttttcgtgaatgacccaatgtgaggcatcatctatgaagattaagtcgccgtttggaatcatccgttttgtttccttggcgagctttttgctcagcgcgcggtcgttgacgccccatattaaccggtacggaacgggcattttaagcggaacggcagggcctaaaccgccggctctgatcgcccggtaccagttcagcatcgccgtgagcgctccttttctgccccatgcttctttgtagctgtcgacatcttcccgtgaaaaaagcgccgggcgttcagataagccgatcgcgtgatccaatacgcggtaatcgtcttcagacaatctccgttccggcttttccggaagctgaaagaaagcgatataagagcttttcttccactgcggcgggtagaacggtgtgaccttccgcataaccgccgggtgcgggatattgaccgtgatcaatttttcaacgttttgcggccgcgtggatgccaaatgccaggccacggctcctccccaatcatgtccgatgacgacggctttgtcatctgtaaaatgagtgatcagcccgataatgtcgtctctgagcgtatcaatggtatagttttcaatgccctccggtttgccactgagattatagccgcgctgatcaggcacgacaacatggtatccggcatccgccagcggtttgatctgactcttccagccgtaccagaattccggaaacccgtgcagcagcaccgccaaaggaccgtctttcggaccggctgaagccgtgtgcagcgtcactccgtttgtttcgatcatgtgaaacgtaatgtcattcatcgattctcctccccgtttgtttcaatcttctttctgttaagacgatgatcagtacgctgatcgcgatcaacaatacggcctgaacgatcagggcgaacggctgagtcagccggataagcaggctgcccgcaaatccagctgccgccgaaataaggccgaacagaatcatgaggagcgcactgaatcgattgccttctttccactgcgactcatccgccatagagcgcttcgtccgatatccgtacaggctgttgatcgacttcggcggaaaaaacgtgactgaaatgccggccgcagccatcagaaggccgccgattaccattatcatatccgtcactctccttttcatcttttacgaaaggaaaggcgaaaggtttcagaaaaaaagcaggcttattcgcccgcctgaatctttacttttgagttaagtcggccgtttttacataacctgctttcccggcgtatgtgacgtacgcccatttacggtcaaatcctccgtcatggctgaacccccagccgagcacattgacggtttcacccgctttaacagacccttttttgccggtttccaaagtcggcgtataaaaatcggtttgtttcgcggtcaccgccttcaccggctgcttcatcagaaaatgcgtggaaatataggctttgtgacctttgtagtcaatttcagcccaatctgctccttgaagccgtttaacctttacggaatcctctgaacgaagcgtgccgataatccgcccttgtttattgggttctttgcggacgttaagttctcctgctttcacgatatatgtatctgctgcggtgtctatttttgtctgatgaactgctgcggcattcgctgccggatcaaaaaaaacggtgcctgcggctaaaaataagcaaagtcctgcggccggaataaatgcggttaacccctttttcatgttcattgtggttcctccccgctattttataagttattacacatttccacattccgccggtcgtcaaacatgattttcccatttcttttataaaaagaaaaaaccgccggacggtatccggcgggcgcactgctatattaatgcaggagacccctgctttgatccaaataatgagaaacgtcttcccgaacgctttggaacatatggagcttgctgccgtatgattcgatccattccttgacgacgcgttccgtcatttgctctccttggtacgggcggccggcttttgcgtaagtcgcttcgaaatctccccataaaagctcaacccaagtccgcgcttgcaaatagctgagcatgtcatttttctcaagcagcaaattcgtcagtttgtcgatatatgtattcatgtctctgtctcctttccttgggaaaacctgctgcttttacgcagcttgtcacaggcatatactaactttacgtcttcagtccagaaggcgcaaccttttgatattggccgagggggaaaacaaatggtccggaacaaggcaaaaggatttcctaatcagaacaataataagtttgaaggcgaaccgcgggcaaaggatgactacgcttctaaacgggcggacggttcaattaattcgcacccgcaagagcgcatgagagcttcaggcagacgataacacacaccgtaagagaccgggaatgacccggtcttttttttgcggaaaaaaacatcctcttgcggtcataacgctaaataaattccataatatgttaaatgctaaaccgcaagccggtagacaaaaaaggaggggttttataaaatgaagacagtttcaaaacgattgctgagccttaccgcattcttactgtcagtttcattatttgctgtttcagcagaagcagcgggcagcccgcagacatctgtatcaaacagcggtgaggagtttgacgcaaatcagaatcagcctgtacaaacaacacagacatcccccgcttatgaaggaacgggcctcaccaaaagacagcttgcacaaaacagcaaagctgacatcaagtcattaaagccttccagtattattgggacagacgaacgaatcagaatttctcccacaacatcatttccatatcgcgcgacagcacagctgaccgttacatacagcggcagcacaagcacctacggatgcaccggtttttttgtcaatgctgacacgatcgttacggcgggacattgcgtgtatgatcagaaaaacggctgggcatcgaaaattacggcagctcccggccgcaacgggtcatcgtacccgtacgactcttattcaggcaagacattctacagtgtcaaagggtggacagaaaacggtgacacaaactatgactacggcgcaatcaaagtaaacgggtcgcccgggaatactgtcggctggtacggctatcggacgaccaacagttccagtccggccgggctttcctcaaccgtgacagggtatccgtgcgacaaagtgtccggttccatgtggtcggacagcaagccgatacgttctgccgagacatataaactcacttacacgacagatacgttcggctgccagagcggatcgcccgtttaccgcaattacagcgacaccggccagaccgccattgccattcatacaaacggcgggtcgtcttacaatctgggaacaagggtgacaaacagtgtattcgacaacattcaatattggtcaaatcaataaagcttttgtcttctttctcgcggcagccgttttatgcggatgcggcaaagcggatgattccgccgccaaaaaagcactgcccgttacgctccatgttgagaatgcagacggttcaccggcggccggtgtgacggttaccgtgatgaaagcggcggagtcagatcatcagccgaatatagaccgcggagagataataggcaagactgatcaccacggtgagatgacatggaaaagcggcgcgaaaggaacctatgccgttgtttttgaaaaagacggggtaccggaaacccggaatatttccttagctgagagcgataaacatacggtgatcagcattacgttgaaacattgaaaaaagcttgcaggcggaatatcccctgcaagctttttgttatcctttatgcacttggtattcataaacatctttcttctcagacagatgagcgaacgtggaaagcacaaggccgagagccgtcatcagcgcaccgccggcaaacagccatgagtaagatcccgttcccccgagaatcaatccgccgatccaggcgccgagcgcgtttgccaggttaaaggcggaaacgctcaccgcagcggcgattgtcgtgccgttttcagaggaggaaataaccttggtctgcaaaagcggcggcgtgccgaacgcacatgcgccgaacaaaaatgtcgctgaaacggctgcggcgggaaaaacagcgatataaggaaaaatcgccaagacgccgatcaggccgatcatcacaccgatcatcgtgcgcgtcagcagtttgagcggcactttccccgcgaagaaattccccgccactccgccgagaccgtaggcaaataatgcgcctgtaatgccgactgtgccgaaccccgctgaatctcttaaaatcggctcaataaacgtgtaagcgataaagacgcctgagtagccgagaatggtgatcgcaaaggaaaaaatcacttgtttatgcttaaagacactccattcattcatcagcatcggaatcactttcggttttcggttcggtacgaccagcatcagtccgatcagcccgatcaggcctaaaacagaaataatgaaaaagacggcccgccagttaagggcatcccctaaataagagccgaacggaacgccgagcatcagcgccacggttaatccgccgttcatggaagccgcggcggcggaacgtttttcaggcggcaccatttcacttgcaaacaccatggcgatcgcaaaaaaagctccgtgaatggatgcggataaaattctggaaatcgccagcacggcgaagttcggcgcaaagacgctcatcaggttggcaagcacgaagatgcccatcaaccctagcagcaccggctttctcggcagcttaaccgcgataatagttacgatcgggcccgtcaggcagacgcttgccgcgtacgccgtaacaagcatgcccgctgaagatacatgtatatgaaagtcatcggcaatcgacgtcagaatacccataacagcatattccgtatacccgatggaaaatgtgcaaatcattaaaacaaaaatcattaatttcacagatggctgtttcattttgatattcaacgcaaatcgcctcctttttattaaaaaacaacgaattccatcttaaaagatatcaaaaatgaattcaatcattttttactgaaaggttgaaacgaatgtgcccgaaaagaaaaagaggccggaaccggcctcttttgttattatttttcttttaaaacggaaatcggcagtgcttcttccccgtcagacggggaagatc

SEQ ID NO: 9 - DNA, 1084681 bp, Bacillus amyloliquefaciens
tgtgtccccaggcgaatacgccgttgatgtaatcaatgcggaaagtgtcatcagaaccttctatctgatacaccccgccgggccgaaagtcttccgggttcagcatgtaagctttggccatcgtaattttccgttcaagcacggccagttcatttacaatgcccatctgttccgctttacgcgctttttccgtcagtcccgcaatttctgtctgtagttcatgaggcgtcatttgactgtatcgtttgtccatttcagtttactcctcttcctgcaagaattgatcaatatcgtcaatcgagaatccttttctgaataagtactgtttgaccttcattccgctttcatagctgccgtcatagcggtatttcctgatcgctttttccgcatgagccttcagagcttccatctcggcttcatcatcattttcatactccgtctgctccagagcggcattgatgacgtcgaaagggaaaccttttcgctgaagctgcatctgcgcccgctgtctgatctcttttgtggacagctttttgtcttttttgaggattttgccgatatgtttcagcgcttcttgtatctgctcatcaaatgtaaacgcgctgagcgtctccttgatggtatcgtcgtctattcctttcgctttcagctcgcggaacaggacgtcagggcctttgccgtttgtttttttgtgggtgctcgcataggcttcggcaaattctttgtcatttaagtagcggtaatcgtacagtttatggatgacttcagaaatgaccatgtccggtgtttcttttttcttcaggtgatcccggacttctttttcagaccgcatccgatatgataaaaattcaacggcgcggttaaaggcttttttcacgtcatcaccgtgctggatttcaagaatgtcaagctcgtccagttctttcccttttttcaggtcaaaacgcacaagcacgtcggcgtcgacgctgaatgcatatttctcatcaagaaagatgttgaagcgctcggtatttttcttttgggtcgatatttttgtaataaacggcatcccggtctccttccccgccccgatgttcaggcgtttttctttttggcaaatgaggtacagtatatgtatcaacgtgtaaggagagatggatatgaatatcgcgatgacaggcggcactggttttctgggccggcatctgacaggtgtgtttacccgccgggacatcatgtctatattttatcaagaaaacagagagaaaccgaacaaaaaaatgtgacatatgttcaatggctggccgaaaacgcggcgcctgagcgcgagcttccccctattgatgtatgggtgaacctcgccggcaaatccatctttgaccgctggacggacacaacgaaggaacaaatcatttcaagcagaatagaagcgacgagagaagtcagacggattatgaagcagcagccgaaaaaaccccgggctttgattcaggcaagcgccgtcggcatttacggcacaagcacagagaaaacgttcactgagcagtccgatacgtcaaatgaagactttctcagtcatacggctcatatgtgggagcgtgaaggccagaaaattgaagcgctcggcatccggacggtatatgccagattcggcgtgatgctcggtgaaaaaggcgccctgccgctcatggttctcccttataagctgttagcgggcggcaccgtcggctctggacggcagtggctgtcatgggttcatgtcgatgacgccgcggaacttattgcttttgcggcggagcatgatgacttgtccggtcccatgaatgtgacatcgccgaatcccgtagaaatgaagcaattcggaaagacgatcgcaagcgtcctgcaccgcccccattggattcccgtaccggaattttttctggagaaggccttgggagaaatgagcctgctgatcgtaaaaggccagcgcgccctgcctaagcaggcgctgacatccggttttcagtttacgtatgaagaacttgagttggctttaaaggatatcttatctgcataaaaacggaaataaaagccaatcctattggtattctgttttgaaggagggtcttcttttatggaaaagaagcgcgaaaaacatcagcagggagccaatctgaaaaaaatgcaggaagtcctttattccggtgaatttaaaaaagcggaaagagcagccaaacggaaataaactgaataaagatcggggccgggcagatactatgtttgtttgatatcacttttttcagggggcgattgatatgggcagaaatcatactcacaaaaaccgtgataaaaacaaacaaaaacttcctcaagttccggatgctttgaaacgcgaaacagacggcacgtacgaggaatattcaagcgagcttgctgattccgctgaccgcgaagcgcaggcgcggatgaaagccgctgacaacagagctaaaagcaaaacccgctaatacgaaatccccgcctctgtatagagacggggatttttttacaactcggtaaacaggctttttgccggcgtccgttctttcgccttaggctgttcatccggatagcccgtttgaatgatggcggcgaagcgctcattgtctgccagaccgaagtcttggtgcacctgtttgtcatacatgatgcggccgcttttccagaccatgccgatgccgttttcatgtgcgagcagctgaaggttttgaatcatgccgctcagcgccgcgaaatcatcgtttctcgtaaattcattttcatcttcttttaagacgacaagcaaaaatcccggaacggcgctgaggttttttctcatgttccgctctttttcctcgttgaaatcatcttttatttttttgaaaaatgagacgtagctgtccgcaagcttttctttacccgcttcgcttgctgcgtagataaaacgccatggctccgtcagtctgtggttcggcgcgtaaacggccgtttcaagcatatctaatatgacttcagaaggtacggtttccggcttaaacgaccggatggatcttctgtttctgattgtatgtgcaagactttcgttttgctgtagttgttcggttttcggcatgccgattcaccttcctattcaattgaaaatgattatcatttataatataacggatacgaccgtcttttgtaaaccgttacggaagctgaaaattgattgattcggcatacacggccgttcccgtcatctcgattttcatcttttcgttatcttctgtaatcctgatttccacttttccgtctttcccgatttcctggccttgttcaatcgtgaggcattcggcttcagagcctccgtattgccgcatataggccgccataacgcctgaagcggttcccgtgacgggatcttcggtcgttccggagaaaggggaagaaaaatggcgtccgtgcagatcactttccggatgaacggtttccagagaaaacggatgaacgctcgctttcggaagatcgcgcaaaacagcggggaattgtgcgttgtccggcaccatattccgtgatgcttgaagtgatctcagcggaacaatcagtgtccagatccccgttgatccgtaaacaatcggcagctcgctgtgaaaatcctcagccgtaatcccgagcgaggccgcaagcttttctttgtctcccgtaaacggcagaaattgcgggggtgcctgttcgagcgtgatgtatacccggccgtttcgttcagcggcttttgcgggaagaataccggcttttgtctcaatttgatatgtctgatcagcctgaagccttcccttttcaattaatgcgtaaagagaggcgacggtagcatgtccgcataaattcatttcgtggccgggtgtaaaatagcggatgcgcagatcggcttctccgcttttgcagagaaatgaggtttcattgtaccctgccatttcggcgatcatctgcatctcttcatctgaataatcatctccgttaaagacgattcccgcgggatttcccaaaacaggaatatcggtaaacgcttcatatttaaacacggttgcctgtttcattcatcagccttcctttcaccttatgatcatgttattcagtataacagagtaaaattagaatttttagttaattcttcaaaaaaaaagacgccttttaacggcgtctttttttggtttttccgatcaggcgggtgacgagaatcatcgtgacggacagcgatctgtttttacggtacgccaagtatttcccgcgccactccggtttgtatttttctttaaaggcccgcagcccgctgaagctgtacatataccggacgttgttgaaaatgacggccgcgattctttccgaccagaaagatgtaaaagccgttcctacgtttgacaaaggcgccatgcccatattaaaggtggtatagcctttttcctgcgcccagagaaacagacggataaaaagcgcgtccataataccgttcggcgcacttttccgataacgcatcaagtcgactgatatctcgccttcctgatacatcggcatcaggttggcaaaagcgatgatctccccttccgcgtctttcacgtaagcaatcggcgcctgttccagataatcccggtcgaagaaaccgagagaaaaacctttctcttttttcggtccgagccattcgtccgatatgtctttcagcttggcgataaactcggaggaaaacggcggttccccgacatgaaatgtgtagccttcgcggtcaaatttgttgttaatcgcccgcagccccgcttttttcttacctgacagcgtaaatgcttccatatccacgaacgcctcttctccgagcttgaagaagttatagccgaagtcatggtacagcgccagatcttcacgttcgatctgataaaacatgacactcagcccctgcttatgcgcttcattcagaaattcctcaatcacaagcggaaaagagtctctctgtcctgacggatcaccgagcacgacaagccttctggaaatctggccgaacaataaaagcgctttgccgtcgcttgagaaataaaaccgcttatccccgagaaagccgagatggctgagggcgtttccgccttcttccgccaaaaaggacttcagccgttcagggtcggccttttctccgatcggcttcgatcttttatgataaaagaccgtaaacaacaggaaaaacagcggcacaacaataatggccgtcatcgtggcatatgtaatgtgcgaattgttatgaacgaaataatcgtggcgcagcagccgattcattttatcccagataaagccggcaatgagattgtagttaaacaaggcgataataaacagagcggccgcaaaaatcatctggccgagcgtatacgatgcctgctctctgataaactgccgctttaacagcaccagcaatacgatgacgacaggcagaataaagatcgcgctgatgttcaatccttttaaaaaactgaacacaaaaccgccgaccagcgcggcaaccgccattgaataagaacgtttcgtccgtttgtataattcaatcggcaagattaaaagaatcaaagccgcgcttaacgataacgcgttaaacgcaaggagcgccgggcgcggaatatgcgggatgaccgtctccctgtcaatcggcagggcgacggatgccagcacaacgactcccgccatgaaaactaaaagcgacagcgaaccgtaaagcactctgattaagatggcgcgctggaatacgagaagcacgttcgtcgtttccacggcgggcgccatcttcggatttgattccagccgtttaagcgtattttccgttaaatcgccggccgcaaagaacagcccgaacacaaacggaataaatgaatacacaatccggtagatgacgatggatgtcacaaccgcctcctgcggaaagcccatattctgcataccgagcagaaacagaaggtcaaacgaaccgaatcctcccggcacaaggctgatgattcccccgatagcggcaatggcaaatacaccgaatacatggcggacatccgcgtgaatccccatgacatacagggaataatacatgacgacggccgccgcaaaccattcggcaaacgatgccccgatgtaagaaaaaaccggatgcctcggttttgcttcaccgtcttctgcgcgagcttttttattgttgacccaagcggcgattaaggctgccggcacaataagcgccactccggcgattacagcccacagccacggtttctcacctgtaatctctccgaccggcagaatgcgggcaatggtcaggatactgaagacggacagcccgagcagcgctgaggacgtaagccaggcgatgcctgcgacaaggcgttttacgtcattcgtatgctctttgtaaagcatcgtccgcagcccgacgcccgccagaccgccgaatccaaggacattgttaaaggaattggcgataaaggagaccctgaatactttccaattcggaatgtcgaggcgaagcgtccgtttcagcacaaagtcataaaaggacatcgcgctgacggcaaggagaccgagcagaacgagaataaataaatcgtaacgctcaatcccgttaataatatacagcgttcgtttaaaagaaaggtctgtcaattcctttttggactgataaatgactaaaagcaaaactgcaataggaaataatacttttaatatcgataaggcattctttttagtcagcaatgttctctccaatcatcataaaatagcttatttattataattcccccaataatctccaacatattatacactaccacctcacattcaaacaaaactcgtctgcaactttctttctctgattaaaatcagtaatatggtatgcaggagtatgaatgaggaagtgagacgatggattataatctgcatgatacaacggtattaggcggcgatattttttctcctgaggaacgggatatttgggtgctgtacatgaaagtgatgacctcggcgggactcggcgatgtgtcggagtggatgaagcttgatatgagcatgccgcaaatgaaggtgctgatgcttctgaacaaccacgggacgcttaaggtgagtgacatagcggagaaaatgggcgcttctctttcaaatacgacggggctccttgaccgtttagaaaaatcatgtttcattacacgcgctccgtcagaagaagaccgccgttcagtcgtcgttcaattaacggaaaacgcgaaagatattttccgcagcctttatcaaaaaggacatgtaaaattgaagcgttcattggaaacgctgaccgctgaagaaaaacaaacggtcaatcaaggacttgccatcttggcaagagcccttgattcttccaaacaggcatagagatgaaaaaggcctgccggtatcggcggcctttttttgtttgacatttaattcacttgaagtgaataatatattcgaagtgaattaaaaaaggaaggattgatcagtatgccggatccattgcaaacagaaaaaaaccagagccgggccatcactctttttacgatcggtgtgttcatggcggcgctggacaacggaattatttccgctgctctgacgacgattaacagctcttttgatgtttctccttcatggggatcatggggagtgaccctttacacattgggactcagtgtcagtgtgccgattgtcggcaagctgtcggaccgatacgggcggaaaaaactgtttatgatggaagtcggcctgttcggactcggctctttgcttgtcgcactcagtcagagcttcccgatgtttttggcggcacggctcattcaggcgcttggcggcggcggaatttttataatcgggagttcgcatgtgctggccgtgcttccgaaggagaaacaggggaaagctctcgggcttttaggggcgatgaacggtatggcggccgtcctcggaccgaatatcgggagctttttgcttgatgtaaccggatcgtggcattggctgttcttgattaacctgccgattgccgccgctttggttgtgtgcggcggtttgtttatcgctgaaacgaaagagcctgaggcgaaacggcttgatctcgccggcacaatgctgctgtctcttgcgatcttatcttgtatgatcggtatcacgaatctcgatgggacgaagctgtcagaaagcataatggacgtaaaggtgtatgggtatcttttgggagcggcacttctctttctggtgctgcttaaggtcgaaaagcgggttgaataccgcgggggcgatccgattctcgcctactcgctgctgcaaaataaagtgtttcaatggacgcttgtcatcggatttttatcgggagggctgctcgctgcggtcatttttattccttcttatgcggagcaatatttacacgtatcggcggagaaagcgggttattggatgacgccgcttgcgttggcgtcaggcatcggagcgtggctcggcggggcggtcacggataaaaaaggaccggtcttctccgcggttgtatcaggcgccatcgcctttgcgggcttcagcctgtttccgttatgggtgacggataaatgggaatttgtcacggcgagtgtcattgcggggatcggtttcggatttctgctcggggctccgctgaatgtgcttgtatcagaaacggcgggccaaaacaaaggaacagcgctcggcacgctgtcactcgtaagacaggtcgggctgacgctcgctccggctttatatgccggcttcattacagcgggctttgaccggatcggagaggacattaaaaaccgtttaacgaaaagcggcattcccgctgatcaggcgcaaacgcccgatatcggcggcggactttcttcgttgcaggagcaggtaagccgaatccccgttcccgccgtcaaaaaagcggtttctgatgcgattgaagcgggcatttccagcggctaccaccatctttatacggcagccgccgtcatttcattatgcacgattgtgtctgcggctgttttggcgtttttccggaagccggcatcctctaagacagatgccagcccatccgccgggaaagctcagtaatatgggcgatgtgatgttcagagtgccagacatatagcccgagcgcctgttccagcgtaaccgtctctttagatacaggatggaagtatgtccgtttgaattgggcttccgtcatggagcgcaaaagagcggcccatcttctgtgcaggatcgttaacagctcaagcgcatccccgcaagcggcggttttggaatcatgaagagcggcccagcctttttcatcataggacggatttccggttcattctccgttaagctcaatttaaaccgggtatagccgttcatgtggctgtccgccagatggtgaaccacttggcggacagtccatccccttcgcggtacggcgtatcaagctgactggccgacatcgctctgacagcttggttcagtttagccggagcgtgttccagcgcattgatccattcttgtttctgtccggccgaaatcgattcagccggctgatactctccaatcggatggctgagggtttgtttttccatttttgtctctctcccgctgctcgtattatgaaagtatgatggtgatgtcgcagccttccgctttcgcttcacgaaagacctcaagcacactctcggcgccattttctgtaagctgcttgctttgttcaaactgtctccattctaaaacaagggggtactccacccatccggtcagacagtcccataaagcgtcaaggttttcaccgtagtactcaggaagggcaagttcctttttcaatgtctggtgcaggtcgctcatacttctgatttgctccccgttaataactgctttattcatgcgcggctcctttctcatgattctattctatcagtttaccattttcctcttcagaagtgaccggagtctgccgcggttccagctggacgatgccttgcccgccgtcaacggccaccctgtccccgttttcagttttgacgttgcatttccgcacccgacaacggcaggaatccccagttcccgggcgacgatcgccgcgtgggacaaaggggcgccgacgtccgttatgatggcagccgctcttggaaaaagcggggtccagcctacattggttgtcgacgtcactaaaatttcccccgccgcaaaagaatcaccgtcttccggagcatcaaggacacggacaatgccctccactctcccggccgctcccgcgaaaccttttaaagtatgcgcatcatccgtttccgcaggcataaaagcatcgtaataatccgctcttctgtcaggatcctcagcccatttaaacggattgaatcttccgttaataacggatggaaacggcggcagttttttataggtttcatagttttgctttctcgcttgaatcgacgcaaccgccggctctttccccgcgagcagatcggttatttcatgcagatacaggaagaaaatatcgtccttcatgccggtcatttccgccgctctgagcgcgaatgctctggctgtccggtacactctgacaaattcggatctggttgtttctctaatattcgcgtattctgacgctttttccattttggctttgagccatttgaccttatgaggaaactttttttcaaatcttcggaaggcctgttcatgcgcccgctgctgtttcaaaagcagttgttcggcatcaatacccgactccttgtgttctttgatctgcttcgtcagccaatcccggttttctcccggatgcggtatggaaagttcgtattcatgcgggccacggtggccctggttcctgagatattcttcctcgctcatacggcctttcatgacttgatcaatgccgataatcggctccaggctggccagtccgccttttcccctcagattggaaagcaggagattcgcatcttctatgcctgcgagttttgttaattgagaggttaacgacgaagaggattgcgcagaatcacgcccgccggatattaacgcaaaccacgcgttgcataaatacggatagatctcatcgttccatatcgctaataatgcctgctccgtttcggcgcgtttcagcttttcctcaatattccggcaccactccggtgattcgtccaagtaggaggacatgttttttttcgcttgcttcattttcgacagatacggtttcagttttttcgggatgatcttcaataattcatactttgagaacggatataaaggtatcttcatttccgccgggatttctcccaatgtatcgctcatcatttttccaatttttccgcctttcggattcagaccgaaagcggcgagaacggaaagaggctggctcatattgttataggctctgccgcaaatattgccggaccagacataatagcccggaatgatgcccgactcttcatccagattccggaggagcgaccatgtcagcggcgtcatcacatcgggaatcgcttctcctatatttgtgtttgtccataaaaaatcaccgctgaaagaatcgttccattcataggtttccagatttccggcttgtaaggtcgtaatcgggcgggattgaagaatatacaatgtcccgcccgcggcggcccattcaatatcctgcggccctccaagatctttttccagctttttcgccagtttatagagctttgacgcatatttgcgaaattccccggggccgtcatattttttcttgggccgtgccagtttaaaagaataggcatcggcttccccggaaacgagctgctccccgagaccgtagacgtaattgcctgtcatctcccgcctgctccccgtaatcggatctgcggtaaacagcactccggatatctcagacggtatcatcagctggatgacgattgcgatttcatgctcatcttccattccctgaacggcgctgtacgcttttactctttctgactgtaccgaccggcggacttcatcaatcgccctggacatgtcttgatctgttctgacattcaacaccgtatcgaattctccggcaaaggaagcctgagcggaatcctcgctcagcgcggatgagcgtacggcaaacaacgcagatgcatggcggctgcggatggaattcacatattgatcaacagcctctctcgcctgatggcggagctgtccgtcctgaaaggctgacggcaaaatcacaaacccttcaggcacaggatacccgctttgatacattttagagagaatgcttccttttcctcccgcaaaggaataaagttcggccggaagttctccgaatgttttgacacagtcattcataatgtccccgctcctttttagtcgttcatccaagctcacagtttttctctttttcactttttttgaaagtatttcctataagtatacaatatatcggtcttcacaagggagaaaatcggtggcgttattttgtcataaatgcatccgtcaaaacagccgcaggcgggggctttgtatgcaggatgtacaactatccgtcctcgtgccggataaagcggacccgtatcaaaaaggcggccgaagcgccgcctttttttcagactgtgcggccttgatgcgccgccgtatttcttttggtctgcttcggctgatacactttcccgacaaacaggtatccgtatctgaaatggttgcacccccacgatacgaaaatgggacctagcgtgcagatcaaaaataaaagaaggatggcagccgctaaaggcattgaccgcaaatagccttccagaagatatccgctgattaaaaagtaggagtgcagcagatagattgaaaacgaatagttgctgatcatcatcacaatcgcgggcacttttttgagctttgaaaacagatgaaaacacagaaagatcatactgaccgcgtaaatcataatatccggacgcttagaggaaatggagccgccgctgatatatgaaacggccacaatcaatattgccgatacggccgcactgaagtaaaccgcataacggtactgattgatgagcgataaaaaacgcggatattcctttccgcaataaaatgccagacagaaataaaacacccagcccggaaacggaacccaaaagaacggaaaaatagaatcaagccccgatgatgccggcggatgaaagatggaaaagtaagccagatagacggcgttgatgataaacgaaacagacagcacccacacgggggatgtgttgttcagccagcggtgcagcagcatatggagaatgtaaaattgaaagatcacaagaatgaagtagccgatgaagtttcctaaaaacacattttctaaaaatttaccgatcactgaaacgaatccggctccttcttccgccacgcttttcattaaaatggcatccaccgcggcaataaacagaaacggcacgaaaatgactttgccccttttctttaaaaaacccgctggaacgcctttcgggtatgacctggcaagcagaaattccgaaataaagataaacgccggcgtgctgaacatcaagagggtccgaaacgcatcaaccgtatgggcggcactggctaaggactcttcctgaatcatcagcaccattgaaactgcgtgaagcagaacgacacttaaacaggacaggcagcgaatcacgaaaatttcttttatctgcatgcggccgctcctttttcacaagcgcgccggactttggcgtatgcttggcgcagccatttttcccgcagttcgggtgtgctcgttctgacgacagaaaaaaggttccgctcggctttttgaatgccgcaaaattgcagaatgctttttttcagcgtaatccagtccgagtttttccggaaccactttaagtaccagcccggggagtccgccgtataaaagacctgtgccgtctctgcccggagcagtccttttacgcggccgttttcatatgtgtaggcttctccggcgacaagcactctgtcaaaaaagcctttcataatcgccggaacgcctccccaccacagcgggtagatgaaaatgagatgatccgcttctttcatcagtttccggtatttcttcgtttcagcgtcccggttcatgtcagagcgctttttttcgccgccgtacttcagcacgggatcaaattgatcggcgtataagtcaatgaccgtatagctttggccgctgtcctttaaagccatggcgacgtattttacgagagccgcattgaaactgttctcatccgggtttgcatacacaatcaccgtcttcatatgtccctcccagtatttattaatttttacaatgattatatcatgatgtcatatgaatgaggcaaagacacgagaaaggctttttccagttctgctgccgtttcgataacccctttctgcatatttttgctgattttggcgccgcggattcaatgataagcatccggtgcttctgcgtttttgagcggccgtatggtatactagctgtcaaatgaatgggcttggaggacaacatgagaattttaaagtacgcgattttagggcttttgcgaaaaggcgaattgagcggatatgatatatcgagctattttaaggaagagctcggccagttttggagcgcaaagcacagccagatttatccggaattaaaaaaactgacggctgagggatttattacgtttcgcactgcgattcaaggaacgaagcttgagaaaaaaatgtacacgctgactgacaagggagagctggagcttgctgcctggctgacgaaaaaagacccgattccggaaacggtgaaggatgaatttatgctgaaggcttatttcatctcagctttgacgcaggaagaagcggatgagctattcaccgatcagctcgtaaagcggcaggagaaattgtccgatctggaaaacagttatcaagaactgatgacatcgtccgcggaggcggattcattttcttctcctgatttcggccattatctcgtgctgacaaaagcgcttgagcgggaacggaattatatttcctggcttgaagatattttggctctcatcaaaaaagcataaacaaaacggggcggctctgtatctgcaggccgcctgtttacgttctgaggaccgcattgataaacgaatcagccattaaaataagaaaaagcagactgaaataaacaatcgaataaaaaaacatccccttcgaccattgcgtgtcatccgccgcctgaaagcctttgacgctccggtacagccagatggccccgagcaggagagcggacgcggtataaaacgggctgacgtctatataaagaggaacgagcagcgaaaccgcagtcaaaacggcgatatagcgcagcatttttatttttgtgacgcgattgccttttatgatcggcaaaagcggaatgccggcggcacgatactcttcctttcgcctgattccgatcgcccagaaatgcggcggctgccacaaaaacataatcgcgtataacaaaatcgcgggcatatcaatgtacccggccagcgcgcaataaccgattaaaggcggagccgcccccggaaagctgccgacaaatgtgctccagacggattgtcttttaaaccaaagcgtataaacgacggcatacagcaaaaatgcaagcaggccaagaacggcggtcagtacattaagcgaagcaagcatgatgaatccgcatacgccgagacatgtgccgtacaggaccatgaccgtcggcggtattcttcccgtgacgctggcgcgggtgcgggttcgctccatctttgcgtccatgccgcggtcaaagaagttattaaaaacagtgcttgacgccatgactaacgccgtgccgatcatggcagccgccatggcggcaaatataccgggccctccgtccgtcctttccgactgaagccacgcgatccaaaatccgcctaatgcggcgagtgaatttgagatgataatccccggtttggcaagaatgataaagtccttgaacgtcatccggtttccgttatgcttcatagactgttccgtctgtgctgcatttgaattcatttgtggaggttctcctttttcggcttatcatatcaggaagaatcaggaagtacaatttattttgggcatttttcacacaattgtaaattgtatatgaaaagccgcatcttgtgaccggatgcggctcttccctttttctattcaaagtctgcccatacagctccctgatccgccgaacggacacccattttcaatccagcggatgccctgagttcgggccggcgatggcgggctccacgcgtcatgtttgcgcctcactgagatgttcgctctcttcagtcacacaaaagccgggtgtatattgcaaatcgacgttcttctttcccgagcctttagaaaaataaaaacccttgccggttagacggcaagggttgtttcttacagtgtaaatgcgatatccgccctgatacagggtctttgacgaatacgccctcttctctttcttcgatctcaaagccggcatcggtcagcgcttttgtcacacgtgacagctctttttgatgcggcagcgtgatggtgtaataatccagcccgcttgcatttcccggtttcggcggcgcatgttttccggcccatatattcagaccgatgtgatggtgataccctcccgccgaaacaaacagagcggacatgcccgcgtaattgccgacaatgtcaaaaccgaggatatcggtgtaaaacgctttggcttcctgtaaatccgtcacatgaagatggatgtggccgataacggttccttccgggagacggcttttccgttcagctccggcttcttccaaaagcccgtccacatcgacgggcgccgtttgcatgacgtaattgccctctgcatcccggcgccacgtgctgcggggacgatcggcgtatatttcaatgccgttgccgtccggatcagacaagtaaagagcctcactgactgcgtgatccccctgcccgagcgcgatgccgttttcaatcagcctggccaatgcgatgccgagttctttccggtcaggcagaagtatcgcgaaatggtaaaggccggtgacagaccgctccgggagaacgacggcgctcggattttcttcaagcaccagcaggacgcgttttccgtctgctgacagttctgcagaacgatctgtctgcgagatgacttgaaggccgatgacattccgataaaagccgagcgagcgttccatatttttaatcgtcaatttgacataaccgattgctgtatcttgatgaatgccggtcatttgaacgccttctttcttatgctgaaaaagtttctcccttttttgatttgaaaaggagctgatccaatgaaagcagacggcttcctgaaagcgctaagtgaattgacgcaaccagtaagatgaaatcaaattccgatccgcccataaatggtgaggaaagcttcgccgtgaagatggcgccgactaatgtgacggcaaacagaacgccgataatgcgcgtcgccaaaccgaaaaagatcagtaccccgccgacaagctcaatcgtcgcgatgacgtagaccataaaggccggaagcccgatgctctggaaaaattgcgtagttccttccaacccttgaaacttggataaaccgtgaacaaaaaagataatacctgttacaacccttaaaagcagtgttcctgtttcgaatgatttattcataaaatcctccttgaaaattattatcacttactttatgtaagctagtatatatacataacttatttacgtcaagtaattttgttacatttaacgaaaataacttaaaagtactatttgtcttcgcaaaaaaaagacctccgcactctgtcggaggtctttttccctacctatgattcccggaactggctctcatataattcccggtaaaacccgttctggctgagaagttcggcatgggttcctttttcagccatttcgccgtctttcagcacaagaatctgatcggctttttgaatcgtgttcagcctgtgagcgatgatgacgcttgttctgcccgccattaaacggccgagcgcttcttgtattttcacttccgtcaccgtatcaatgttgctcgtcgcttcatccaaaatgagcagcaccggatccgccagcacatctctcgcgatggaaataagctgtttttgtccttggctgatgcccgcgccgttttgggtaaggacggtatcgtagcctttcgggagccgttcgatgaatccgtgggcattggcggcttttgcggctgcctccacctcttgatcagatgcatccagacggccgtaacggatattttccctgatggtgccctgaaagagaaaggaatcctgcaggacaaaccccatgttttttctcagactggacctcgtcagttttttgatgtccgttccgtcaatgaggatttttccgttattgggctcgtaaaaacgggcgatcaggctcgtaacggttgttttacccgctccggtcggtccgacgaaggcgattgactgtcctttcggaacgctgaaggacagatgttttaagatcgggctgtcttcctgatagccgaaggagacatctcggaattcaatctctcccgttttgatcggctggtgcgtcgcatgctcttcatcttcccgctcctctttttcatccagcacgtcaaacacccgctcagccccggcgatggccgataacatcgtattgaactggttcgccaaatcatttaaagggcgcgtgaactgccgcgagtattctgcgaatacgacaatggaaccgatcgaaatccaccccttcagcgcaaacagcccgccgaccgccgctataatcgtaaagcttaaattgtttaaagagttcatgactttcggaatgaatcccgaaattgtctgcgcccaaaagcctgatgattgtaacgccgcgtttttttctaaaaattgctccatgacgcggtcttccctcgaataggctttaatgaccttcgctcctgatatcgactcttcaataaaaccgttcagctcgccgaggtttttctgctgctgcttaaacaggagtcccgtccggttggtgatccatttaatgctcaaaagcatgatcggaataatcaaaagcgtgatcaatgttaaaagcgggctcatgaacagcatgacggcgattgtgccgacgaatgtaatgacgctcgacagcacttgaatgacggatgtatttaaagtggagctgacattttcgatatcattggtaacccggctcatcaaatcgccgaggcgctgtttatcaaaaaacggtatcggcagctcatgcagatgggtgaacagctcgctccgcattttaaacacggtgctttgcgagatattgatcatccaatagttttgaaaccataaggacaatgattgcacgaggtaaatcccaaacagtatgaacagtacacccgccaatccgtccgtcgtccgtccgacgataaaatgatcaattgctttcccgatgacgaacggtccgagcaggccgaatatggcgcttatgactaccatgatgatcacaagggttaaaagcccttttttctcggctacatacgaccagattctgcgcagcgtgccttttgtatcttttgctttcgcgcgttttctgccgccttcatttgatttgagcggtattttcggatatcggaaaggtttacgaatgtctttctccactgtcagctccctcctttccgaattgtgattcataaatctgccggtacagatgagactgtgccatcagctctttgtgcgtgccttttgccagcaattcgccgtcttcaagcaataagatggtgtcagccttcatcgcggtggttattttctgcgtaataatcagtgtcgtgcattcataggatctgatcgcttgtaaaagcttcgcttccgtttgaagatcgagcgcgctcgtactgtcatctaacagcaggagggacggctttctgataaaagcgcgcgcgatggaaatccgctgcttctgcccgcctgacaaattgacgccccgctgtcccagcaccgtgtcgtacccgtttgacagcttcataatcgtgtcatggatttgcgcgtctttggccgcttccattacttcatctagtgaagcttcctcccgtccccaggcgatattttcacggattgtgcccgaaaacagaagcacttcctgcggcacatagccgatttccctgcgcagcccgcaagcggagaattcaccgatcggtttgccgtctatgaaaatactgcctgaatcagccgtgtacaggcgcggaatcagctgaaaaagcgttgatttccctgaacctgtcgcgcccataatggcaaccgtttctttcgggctggctgaaaaggacacgtgatgcagcgcgtctttttccatgtccggatagcggaaggacacttcgcgaaactcaatcccgcctgcaagcgcccgcgccgggtcgtgccccgttccctcgccgccttctgtttccagcacctcgccgattctttccccggaagccttcgcccgggaaaataccataatgagaaatggcaggacggacagcgcgcctgtaatccgcgtcgcatagttaatgacggaaacgacatcgccgacctgcgctccgccctgagcaatgcttttggcgccgaaccataagataaacaaaatgcagctgttcatcagcagcattaaaatcggcatcgccgcttccacgagacgaaaagcggaaaccgttttttccatcagcttcgtattcgatttcaaaaaacgtttcacttcgtggtttgcacggaggagcgctttaatcagtttgatcgccgtcaggttttcctgcatgatcgtgttgacctgatcaagccgcttttgcacggaccgaaacagcgcgccgcctcttttcagcacccacagcaaaaacaaaagcaaaaccggcaccgtgatcagcagaaaaaaaccgagtttcgcattgacggtcagcgagagaataatgcccccgcaatcattaacggcgccctgagcataaaccggagactcatgaaaagcatattctggacctgcgtcacatcgtttgtcagcctggtgataaacgacgtagatgagaattgcgcaaacgtcgaataagagaaggattgaattttttgaaaaagcccttttcgcgtatcatacgcatagctctggctgatgtgggcggagtagaatgaatttaaaattcccgatgcgaatgaaacagcggtcagtccgatcatcaccccgccccacagccaaaccgtaccgagatcctgctttaaaattccttcgtcaatgattttcccgatcagcaggggctgtatcagctctaccgcaagctcgatgagcatgaaaaacagagcgattcccgccaaaagggaatacggttttacatatgataaagcctttgacatgtgtaagcctccaaatcctttgttcaatattattattttatgcctttccggcaaatgaataaagaaatttggtgtgccgttttttcaataatctgcgaaaaagataaaaccttcccggggaggggaaggttttgaccttattgatccaattgctgttcaatgcgctcccgcatttgcggaacgcctaatccgacaatgacctgaagcgccctgccttttctgacgacgccgtgggctcccagctctctgaaatcggcgtcacttttgacctttgattcatcagcgacagtgacgcggagacgggtggcgcaattggtgacctccgtaatattgtcctttccgcccaacgcttcaatatacaaagcggctgtatcccgctgtgtttcgtctgccgcagccgtttcttttgaagcctgcttccgttctctgtactcctttttcgaatagagctttgtttcctgcccttcctctttttctctgcccggtgtggcgatgttgaatttgagaatgaggaaacggaagacgaaaaagtaaacagcggtaaaacacagcccgatgatgatctggtatacatacgtcaaaccgtggcttgacgccagcgggatccagttcaaggtcgcagcttcgatcaaaccgcctcccatatttccgacgacgcctgccatatacatgacggttgccatggaagcggcaagcaaagcatgaaccgcaaataaaaacggcgagataaaaaggaatgtaaattcaatcggctctgtaatcccgctacaatggacgtcaaggtgaccgggatcaaaaggccggcgacgatttttttcttttcctttgaagccgtggcgtaaaaagcgagcgcgattcccggaatgccgaagattttcgagttgccgtgaagcgcgaagcccccctgcgggaacaattctttcagcggtttgacgctttgagagtattccccgagatgctgggcccaataggtgacgataccgccttcagccacagccggaccgtaaataaacggcgagtaaataaaatgatgcaggccggtcggaattaaaatccgctccaggaatgtgtaaatccacacgccgatcgccccggaagaaacgagaaaactttgcagcgatccgattccggactgaaccatcggccatacgtatgccaccgcaagtgaaatcggtatcataatgaagaaagaaatgataacgatgtaggaagatccttgaaaaatccccagaaaatccggcagttttttatcaaagtaacgattgtgcaaatacacgacaatagatgaaataaagatggcgccgataatattcgtatcaagcgttttgatgccggcgatcatcgtcagcccgctcgttccgccggcttcctgagtcatatcgacatgaaaagccccgccccaaaccgtcagaatcgcattgataaagtaattgaatgtcagataaactgtaagcgcttccaaacaagcccgcgcctgcgcttttttcgctaaggcgacagggatgccgatcgcaaacaggagcggcatttgattaaagacggtccagccgccctgttcaatgacgtaccagcattgataccaaaacccgtcaggatcagccagcggccccatcagcgttttatttttaaacagcgtgctcagaccgacaataataccggaaaatgcaaataataaaacaggcacaaacatcgcgctgccgaagcgctggactttttgcatcatttcacgtgacctcccgctatttatcaaaattttcgagctctttataatcaacatatgcacggaataacgcttcgcccaccagaaaaaacggggcaaatgcgacgatttccgttttatcgcttaacgtcaccggcttgctggtcgcataaagattatacggcgtcgtttgcgccagtacgttgtttttcagattggtgattgaaataaacggaactccctttgcggacagggtccttacctgcggaattaattcgggtgtttcgcctgataaagaaataatgatgaatacgtcatcaaccttaaaatcatcacacatgatattaaactctgtgatgtcctgaattaaaatcagatacttccgccgggatacaaacatccgctgcagctcacgggcgcacaccctctgagccgtccccgatccgtaaacgaaaatccgttttgcttcatctatcagccggcacatctccgtcatatcttttgacttcacgtattttacattggcttcaatatcatccagcagcttttcaaacgtcatattctcgccctcttcaggctgatcctcccatttcagaaaaacacggaattcactatagccgctgaagcccagtttttgggcgagccgcaggatggaagaccgagagacattacaggctttcgccatgtcattgataccgagatggtagcacgtatgtttatgattcaatatatattttaaaatataaaaatcgttgtcatttaatttcgcgtaatgctgattaaccagttcttcaagactcatcccaaaaatccccccgttttctttctattatatagaataacagataaagaaaacggggaagattgtcatcaggaaataggagacgggcttacatcaagctcaggccagtagtccttattagcctccatcagatcttcaagaatcagtcttgccacacgggcattcggcactgtttttgacaggatcagcgcctgccacagcttttgaaatgaccgctcttcccacgcttcagccgtcagtttttcgacagacacctgctgttccatcaggcctttttgaaattgcggtatgttcccgactgagagcggttccggtccgtttgaacctacgagacaaggaatctcaaccatggctgacggatcaaagtttgcgatcgcaccgttattttcaacgattaacagcattctctccccggtgttataagcgatggcccgggcaagatcgacgatataggaagcatgatcatcaattttaatttcactgttctccgatgattgttcgcgcgtaatcatatcgcattggctgaaaatgaaagcttcgcgcccttccatgacttcgttggctctcgtatggttcggatttgattttttcaccatatcatccgggaataagtaatattgcagatatgtgttcggaagcgtatccggatcagccgcctgtacgtcgcgcgcttttttgaaggtgtcattccagcttgcttcagtctgttcggcctccgtcttcggaacgtagccgtattcacggacatgctctttcagcttcggcattaaatcattgccttctcgatccgtgatggacgtccaccagccaaagtggttcaagccgtagtaacggacgttcatttcttttcgtgaagataatccgaggatgttcgccatgcgatcctcaattccgaccggcatgtcgcagatgttcaatatttttgaattcggtctgaggcgccgtgtagcttcggccacaatcgccgccggattggagtaattcagcatccatgcgtcaggcgagtacgtttccatataatcaagaatctccagaacaccgccgatagagcgcatgccgtatgcgattccgcccggcccgcatgtttcctggccgaccacgccgtacttcagcggaatttgttcatcgagcgcgcgcatcgcatattttccgacgcggatatgcgccatgacgaagtcaacatccgtaaaagccgtctctgggtcatcagtcgccaaaaattcaatgtccggcgctttttcttttatgaatacctcacacgcacccgcaatccgctcctgcctttctttatcattgtcataaagtttcagctttctgatcggaaactcttccaggtgattcaaaagcattaatacaattccgggggtaaatgtgctgccgccgcctgcaataacgattgagaatgatttgtctgtcatgtgaagccctcctctgataacgtttacattttatttatatcatgagaaggtccgatctgtaccgggtttgaaggagttagatcatttgatcatttttagttatttttctcaaaaagcgggaaagttcccacaggtacgaaaaaggcctgctgtcatcagcagaccccttctcaaaaatgctcttgtaaatcagaaagcagcacttcctgctcaaattgtggatttccgatcggaaaaatcctggctgtttccttgtcttcgttgacatgctgaatataaatcgggactccttcatacgtcacatacgccatggcggcggattccgaaatgtctttcgcacgctgtgtattcacgtctcaaacctcctttagtcctcacacataacgtgtccggcacccaagagaagtatgcttgtttcttacaattgtccggcggtgagtttgaattttttgaggcgtttgtaaaacgtgctccgcgggattccggccattttagcagccagcgtgacattccccttcgctgattcaagcgcgtttacgatgatgtttttctgaatgtgctcccggatggagacagaggacgcttcttcctgttcataagactcggccgcttctttaagacctgacgcttcaagcagggctgcgatggggcgccctgacagccgtccgtccgggaacatgacggaaagacgttcaaatacattaaacaattccctgatgttccccggccatttccggctctttaatacgtctaaaaagtcaacaggaagctcccccgccagccgcgatttcgctgaaattcaaggaagagtccgggaatgtcttcggtgcgttctcttaatggagggaggtggatcggacagacgtgaagccggtaaaataaatcttctctcagctttttgcattcgacaagctgtctcagatcagtgtgggtggcagtgatgattctgatgtcaacgggaatctcttttgtcccgccgaccggggtgactttccgctcctgcagcacccgtaacagagccacctgcatggagtgtgatatttctccgatttcatcgaggaaaagcgtgcctttatcggctttttgcaaagcgccgctatgtcctttccgtttggccccggtgaaggcgccttccgagtagccgaacagttcgctttcaatcagcttttcggggaccgctccgcagttgacagcgataaacgggccgtttttcctggagctgttgttatgaatcgcccgggcggcaacctcctttcccgtcccggtttctcccgtaagacaaacggttgcgtccgttcgggcgacaagctccagctgctcaagcatatgtcgggatgacgggcttttgcctgccgcaccatgaaatataaacgacggcttttcttcccgtttggataagtaaacgcatgtgaagccgttctcctcccgcttcgtccgcttgatatgatagccctgttcctcaagctcgcgcagcatatgtccggtaaaatgctgaacgggacggcttgcggcgataacccggctcatttcattgcaaagcacgatcggatcatgagaccgggtaagcccggcgaatttgctgatcatgtcaagttctgtcattttgatctttagggcaagctcccgttccgccgtataagcgatggaggaggcaattccgagcataaaaggctgagcgcgggcggcggggcaggaaatatcaatgacacccgccagccgcccgtcttcataacggatgggcgcggcggaacagctccattgatgagaagcgagcgaataatgttcagagccgtgtatcatgaccggttcatttgtataaagagccgtcccgatcgcattcgtgccgacggccgtttccgtccagcgggcgccttttaagaaattgatgcggttcgcttcatgaatggtgcgcgggtggccgtcaactgaatggacaacgccgtctgaatcaatcaggagaaccatcatttccatttcccgcatcgctgttttcattctttctgcgtgcggcattgaggccgctaaaaataacgcatgcttttcggcctgcctttctaaatgatctgccggcattacattcggtcccttttctagataagggttgacgtcggcttttttgcagcggtgccatgaggcggccacccgcttctgaatacgggattcatcgagcacgccttctttcacaaagcgcttccaggttttaaaatcattccgaatgacattcattgtattcgctccccctgttcagaccatcttttcatatattgtaggggaaaagtaaagcgctttcaacgaaaaataccccttctcatctgagaaagggtattccggttatacggaatgcaccgcaagtccggtgacattcagcagggcttcctgaagcgtttctgacagagtcggatgcgccgcgataaagtgctccgacatatccgccgtcatttcaccgttcatcatcatgaccgcctgaccgatcaattccgtcacgtccggtccgatcattgacaccccgacgatttctccgaattccggctcggcaatgattttcattttgccgccgtgctgatgcttaattaacgcttttccgttagcagaaaatgagcattctccgattttcacatctccgtatgtctctctcgcctgtgtttccgtcagcccgacagctgccatttccggcgatgtataaatacagcggggcaccgcccgcatattgactttgctatcctttcccgaggcatgcgcggcggctgtgattccttcatgaatggcggcatgcgcgagctgcattcctccggccgcgtcgccgcacgcatatatatgaggcacattggtctgcatatggtcattgacttcaatcccgcgcggagaataccggatgccggcttgatccaaattcagcccttgcaaacgcggttttctgccgattgcaaccaaaatgtgatcagcctgagcttcaatttcttttccgtcttttgtccacacggcggttttcctttctttgtcaatccgctgaagggcggcttttgtctgaatatcagccccgctgtctcttaaagagtcttcgaaaacggcggcgatttccctgtcttctgccgggagcagccggtcagccgattcaatcaccgtcactttcgttttaaaccggctgaataaagaggcaaattcgcagccgatcacacctcccccgacaatgagcagagacgaagggattttctgtaaagaaagcgcatctttgctgtcgattacccaatcgccgtcaaatggggcaaacggcagctccgccggttcagatccggatgcaatcaatatccggtccgcttccagaatgtcttttgcgcctccttcttcttcaacaagcaatgtctgctctgtgagaaatgaggctgtcccgctgatgactttaatctgatttgctttcattaagtattgaattccctgcacgagctggctgacgatttgccgtttgcgcccctgcatgcggttccaattgagtgtaatgttttgcggcagttcgatgccgaatgtatttgcatgcctgattttatcgagcacattcgcactttccaaaagcgactttgtcgggatgcacccctcattgagacaagtgcctccgagcggccctttgtcgatcagaacgacttctgctcctctccgcgcggcagtcacggcagctgcatatccggccggcccgccgccgataatggctagtttcattttttcacctctctctataaaatcaaaccggcaggctcttcaagcagcgctttgaccgttttcaggaagtccgcagccggggcgccgtcacatactctgtgatcaaaggtaagactcagcggcagcatgatgcttttgacaagctcatctcctttaaacgccggcgtttcatagcttgcgcccactccgagaataccggcttcaggcggattaagaatcggggtgaaatgctcaattccgtaacccccgagatttgtaatagaaaatgtcgaaccgtggagatcatctccggaagcattgccttcccgcgcccggcgtgccgatgtgctgatgtgatccgcaagctcaaggaatgaaagcttttccgcatcccggatcaccggcacgacgagaccgttttcaagagaaaccgccatcccgaggtggacatatggataggtgatgatccgctcctcttgataagagctgttcagctcaggatgctgtttcagcgcaagcaccgcggcccgggatatgaaatgtgtgaccgtcagtttaacaccgctccgctttttcgcgctgtcggcgagctgctgctgccattttacaagctccgtaatgtccgctttcatcgtcagcgtcagctgggcgctgttttgcaggcttttgtgcattcggtctgcaatcacttttctcatcgctgaagccggttttccctccggctgtgctgtctgaaccgaagactgcggttcagcttctgtcttcatcgccttgatgacgtcagcttttacgattctgcctccgggccccgtcccgttcagcgtatcgactttcaacccggctttctccgccatttttctggcaacgggagatattttcacgcggtgtttgcgcttttgcccggcttttggagcgggaatatgttcaggttcagcttgcggtttccctgctttttcaggagccggcgcctccttctcccgcacttcttcgccgttttccccgatataacagatgggcgttcccggcgggactccttctccctctttgactttaatgtgaagaagcgtgccgctttcaggcgcttctatttccatttctattttttccgagttgatgctggcgatgctttctcccttttctaccgggtcgccgacttttttattccagacggatacttcacctttcttcatcgccattcccagcttcggcattactacttttacagccattctgtatccctcctttaattcattgccggctcgccaagcaattcaagcgtgacgctgacaatttggtctggtgtcggcaaatattgatcttcaagcaccggcgaaaacggcaccggtgtatgcggcgctgtaatccgcttaatcggtgcatcaagcaaatcaaagcccttatcggcgacaatcgcagcaatatccgtggcgatgctgcagcgcggattggcttcgtcaatgatgatcagccggtttgttttttctaacgatgtgaaaatcgcttcctcatctagaggagacagactccgggggtcaagcacctcggcgtcgatgcctttctcagaaagctgtgcagccgcttcaagcgcggtattaacctgcttgccgaccgcaaacagcgtgatgtcgctgccttcgcgtttgatatccgcttttccgagcggaattgtataataatcttccggcacctcgcccttcatgctgtaggacgttttgtcttcaaaaaagaataccggatcattgtcttctattgccgccagcagcaaacctttggcgtcatacggattggacggcacaaccgtcttcagccccgggatgctggtgaacaggccatacagcgcctgcgaatgctgagcggctgcccggaacccggctccgtatgtggtgcggacggtgatcggcacttgcgctttaccgccgaacatatagcggaatttcgccccttggttaatcacttggtcaaagcacgttccgataaaatcattaaacatcagctcggcaatcggtctcagccccgtggatgccgcagccatggccgcacccatatagcccgcctcagaaatcggtgtatccagcactcggctgcgcccgaattcctgtacgagaccctttgtgaccccgagtaccccgccccatgcctcatcatcttgcaaatgatcgaccgccgctcccccggcgacatcctcaccgattacaagcacattgtcgtctcttctcatcgcaagcttcattgcttcattgatcgcgtccgacatgcttatgactctcgccatctcacattccccctttttcatatgacacgtagacgtctgtcaacagctcagactctttcggataaggactcttttcgctgaacgagacggctttttcaatcgattcgctgactcgctgttcaatgtctgacaatttatttgcatctgtttcttttagaagatagtttttaaagccttggatagcatccttttcttcaagatgctcagtcttttcatcctttgttttataagtttgggcatcgccttcgaaatggccgtagtttctgtaagtcatacattcaatcaaagacgggcctccgccgtttcttgctctttctatcgcttccccggctgcctgataaaccgctaaaatatcttttccgtccaccgtgacccccggcatgttgtaggcagccgcccgatcggcgattgaatcacaggctgacgcgtactcaaatgtcgtggcttcgccgtagccgttgttttcggcgatgaacacgacaggaaggttccatactgccgctaagttcagcccttcatggaaggtgccttggttattggctccgtccccgaaaaagcaaacgcttacatttttagtttgtttatatttagccgtgagcgctgatccgcatgcgagcgtaaatccgcccccgacgattccatttgcgcctaacatgcctttatcaagatccgcaatgtgcatagaaccgcctttgcctttacacagtccggtcgcttttccgaatatttccgccatcatgccgtccagatcacagcctttggcgatacaatggccatgtccctgtgtgtgcttgtaatgctgtcgccatcatctaaatgagcgcacacccccgcagctaccgcttcttcaccggcatacaaatggacgaatccgggaagcactccttgcgcgaaaagttcatgcactttgtcttcaaagcccctgatttccagcatcttttggtacatccacagcgctttttcctcagttaatgacaagccttctcgttttaacaattccattttgtgcgcctccttctatttagggttcacacttataaatgcaagaagcatgccagcctttgaagcccgtaaaatgaatgtttttattttttcaatggagacagtttgagacaggtgtctcattttgtctcgatccgttccctttgtctcgttttatggcatacaaaaaagaccgggcatcaccctgtctttgacaatgatcgacgtatttatttcctcggaaatcttttattgcttcattcttccgcatacagtctatcacggcgtttgagtggttacactctttttttcatatccacgcgctgcagttcatccttttcttcaacagcccgattcagtgcttgaagcatgtaaccaatgcctttatacgatgacagaggccaggtgatatgctgatgctctccgatgacggcgtttagaatgcttcggtattttttcccgccaagcatgacaagctcttcgacgtcggaaaagcctttttcataaaattgacggcgcagctcgtccgctgccatgatctccgggtgaccggttccaaaagtgacatcgtaatttccgggaacagtatcatccggacgaagaaatccgtgcttcgccgacaaaatcacccactcatcgaaaaatgctttcgcatatcgctcgcatgcctgatgaaacgggctgagataagcgtcttccgcccttaccggccctgtatctgaatggacatcccaaatttttttcttgccgcaggggatgatgcacagtcgtttcatttttctctcccctttatgatgtatctcctatcaatgtaccattattcgtttatttctgcatgacgaaaccggccatggatctgtctgggtaaaagctgcacacaaaaaggcccggaattcaaaccgaaatccgggccggatgatgagttgtttatgtcactcttgctccatcccatcaagatactttctctcaaagtcatcgagcaatgcacgcacttcatctgttgactttgtattcatgcattgatttcttaattcacttgctccccggaacccgcggagatatatcttgaaaaagcgggggagcggtttatatgctctggcttctgcttttgaatattcatcatgaagatccagatgcaatctcaaaagatcaagcaattccttactgctatgctctctcggctccttttcaaaggcgaacggattagtaaaaatgcctcgtccaatcataatcccgtcaacaccgtattgttcagcaagtttcaagccggtttcacggtcaggaatatccccattgatcgtcaaaagggtatccggcgcaatctcgtcacgaagtttcttgatttccgggatcaactcccaatgcgcatctactttactcatttccgctcttgtacgcagatgaatggaaagattcgcaatgtcttgtttcagtatgtgtgtcagccagccgcgccattcgtcaacatccgtgtagccaagtctcgtcttcacacttaccggcagacctcctgctttcgccgcctgtattaattcggctgcaacttcaggacggcaaatcaggccgcttccctttccattccccgccacattaggtacaggacagcccatattgatatccaggcccttaaaccctaattccgccattccaatactcatttggcgaaagttttcaggcttatctccccatatgtgggcaaccatcggctgttcatcctccgtgaaagtcaaacggccgcgcacactatccttcccatccgggtgacaatagctttctgagtttgtaaactctgtgaaaaacacatcaggtctgcctgcttcactcacaacatggcgaaaaacgacatccgtcacatcttccattggtgccagtacaaaaaatggccgcggtaattcacgccagaaattatctgtcataacaaatccaaatcctttcatgatgggatacagtgaaacctttatcccaaaattaaaaactgaccatgcttcttttacacttatagcatgtgtcagcacttcttatcaaacgatagtaaattttgaacatttcactttttacacgttaaaagtaaaaaagcaaactggagtagaacacattaattgagctaacgtaatagactaccgctatagtcaaccccatatcgtttatttctgatcaactcagtcaactccttcacctttaaaagggtttgagagagaaaaagtgtgatgattatctacacctaatttttatttatattgtggtttattaagattagcgctgaccttcatctttcttagcggccttacttttgctctttttggataaaaaggattccaacctaaatagaatatcatatgagttctccctattaccataaaacaaatttcaagaaataagttgattaagcaaatggggctggggggtatatctgagtactgaaaagaatgtaaaaagaaaaagccttaacttgccgcttgtgaatcacatggagtaaagaggatggcatgggaaaataaactcgaacttaacagaattcaagaacttcaatctggatcttttcggatttactcatggtctagaaataatcaacgccgcaagtggcttggctctatacagtatatgtactaagggttgatcggcttttaaaccccgtatgttaatatctttatacaatcacctatatatatttgtataaggttacgcttcggtaatcctgatccaaaaccaataaaatagactgctgactaagtgccgcagtcttcattcataagattaattagaaagtgttcatgttctttcatcattaaataaggcatcagaagttattgctttcatttcggatattctttgttatacctttaatgatttgtataacagtgaaaacccccaagaaaacagtgacaatattaaaccatggattatcatagaatgaaagatatgtttgaaagaaatccagttcagctatatttgctgggaatccattcatttctctataattaggaccccatcccgttaattctacaaagttaaaataaagctgtgatactaaaaatgccaacaacgtgtgaaaccaacttcttttatatactttacccatttctttatccatttccttttctgcaatactttttagcctagtgtcaatctaacatcattatatgatgaagcatgattgtcgcaataattacttattaaggatataaccatcgcaggtattactgtaatagttgttatcacttgcgtttccgccttatatttattcctttttttagaacaagaggaatagttggggtccttttcctgtttaggctttcatattatatataacgaccaaacatgcttttttagtgtatttgatcttttatcgacagttgttgatatgccaactgccgctgtgatttagtgaaagttagcacccttgccttttacagcttctacttcagaaccttcgttcagttgttgaaatctcaatatctctcgttcggtttcacctcctttttatcatttattaaagacctacttactttggcatgataaatactttacagttgaataatgttacaacttcatctcaaaccaatgatatcaaattattttacattatcccattaatgtcacaataaaccacagcgtcattatacaaacgaggtcaaaattggctgttttctcctcgcttttccacacgttttttcaactcttttcatcagtttaaattaaagatctccgagaaaagaaggaagataaacagccagggcaaaggctgcgcataaaaaaaaccggaaatcggaaatgtttataccgaaatccaggtctgattacgaattgtttattttagttagacgatttcaacacaagcttcgccacagcttccacatgggccgtctgcggaaacatatcaacaggctgaatatattcgacgcgatagtctttcgacagcgcctgcaagtctttcgccagtgtggaaggattgcaggatacgtagacgaagcgtttcggttttacttttttgatggtatctaaaaatgttctgtcacagcccgttcgcggcgggtcgacgatgaccacgtcgggacggaagccttctttcgtccatttcgggagccagtgttcggctgttcccgtgacatatgccgcgtttttgatgccgtgttttttggcgtttttcttcgcatcatcaattgattctttaatgacgtccatgccgcggatctcttttgcgccgcttgaaacccacatgccgatcgtaccgacgccgcaatacgcgtctacgactttttcttttcctgtcagctgagccgcttgtttcacttcgtcatatagcttgaccgtctgctcagggttgagctggaagaaggcgcgggcgctcagttcaaatgacacgtcaccgagcacttcttgaatggcatgtcttcctgccagcgcttttgttttgtcaccgaaaatgacggatgtgcgcgcgccattgacgttttgaataatcgatttcacttccggcagccggttctgaatggctttgacgatctcgtctttattcggcagtgtctctttcgcggtgacaagcacgacctgcacttcgcctgtttcaaaaccgactctcgtcacgatggtgcggacatcgccttttttggtccgttcgttataaacggatacgttgtgtttttccaaaatacggcggacgatacccgttgttttgtttgtcgccggatgctggacaatgcattccttaatcgggacgattttatgggaatcaagtccgtataagccggcaatgatgctgccgctttgcgagcgtccgacttggaactggcttttgttccggtaattccaagggttgtccattccgatcgtatctttaatgttcatttcttcgacattgaatctcgtatgacgttccagagactgaatgacgatgtcgcgtttttcgcgaagctgctgggtgtatgccagatgctgaagctgacagccgccgcactggtcgtagaccgggcatggcggcgtgacgcggtgttcagacggcttgcggatgtttttgacgcgtgcttctgaaaatttcggctgcacatttgtcgcttcggcaacgacttcttccccgggcagagcgccgggaacgaagacaacttttttcttaaaatagccgacgccctctccgttaatgccgagacgtttgatggtcagcggaaatgtctgcccgattttcaattcggcaggcgcctttttttgatgttgattcacgtttttttctctccgtttctatataaagcctttctcctgggaaagcggctgatttgaaatatcacatcttttcagtataacatgcagccggcggttccttcatgtttttcactggaagtttccaaaaaatgatcaaagcggtttttcattcaatacttctccacaaatataaggacgcatagcttaaatacggcgcccattcgctgcttacctgaagcatcacgtctttcgacggtttatcctcaagggcgaagcggcgtttgatggcattttgcaggccgatatccgccaaaggaaacagattcgggcggccaaggccgaacatgaggacgttttggacggtccacgggccgatgcctctgatggtgatcagctttttcataatgtcttcatccgataaatgggtaagttccgccagattgagcgctccgtctgcaatcatgcgtgaaatgtcaatcgcatattccgcttttctcatgctgaactggagctcccgcaagtcctgataatcaagcgccgcgatcgttttcggctcgggatagcaccagacgccgtctttttgttcaccgaaggcatggacgaaccgttccgttaaggtaaatgcgaaagacaggttgagctgctggtggatgatgcatttcatgagacagttgtagacgtcatattccaagacgagcggggttcccgcatgctcctcaaaaagcgccgacagatttgtttttgagaaatgatcaagcacaggctgaagcggctgttcccattgaaaaatgtgtttgatccgttcaatcatctcctcgcggtccgtttctccgctgacgaggaagaccgggtctgcggcggtgccttccgcttgaaccgtagtgacggacagtttgccgtcccgtgttctgagcggcactttgattgatcttgcatgaagatcgaccgcattcagcggatcgagcgacagcctctcaaggactttatcaaaatgatacggcggcgtgaccgaaaccgtttccttccacatatgctccacccctttttgtccaagtatatcatgaagcgggcgggcggcaattcgtatacttttcttcataacgccgcatgatataatggcaggcggagggttgtttatgatacatataaccgcaatcacaacacataatgagatattagataatatccccctatcacgtacagaacaaccggacatcgcatggtactggatcgattttttcggcgctgagatgcatgaaaccgagctgctgcgggattattttcactttcatccgcttgcgatcgaggattgctttcagcatatgcagcggccgaaaatcgaccattatgacggctaccgtttttatgtgctccacgccttgaacccggacacactggaaatggaagaggtggacatctttcagtccgaccgtttcatcgtcagcttccatttgcacgaatcgcccggcgtctcaagggtgagagaacggtttttcgcttctccgggattagccaaaaaagggccggggcacatcacttatatgattatggatcagcttgtcgatgaatatttccccgtgctgtacaaaattgaagaccggctgaatgaaattgaagacagcagaacacataaatcttacggcactttaatgaatgaagtgtttgaattgcggactgatcttttgaacctgagacggacgatcattccgatgcgcgatttaatgtaccggattttgagccttgaccatgtaaaagaaagccgtgaaacgaaggcgtatttcagcgatatttatgaccatctgttaaaactggccgagctgatcgagtcaaaccgtgatatgacgtcagatttgcgggacagctatgtgacgctgaattcaaaccggatgaacgccattatgatgacattaaccatcgtctcgaccatttttatcccgctgacgttcatcgcgggggtttacggcatgaatttcgataacatgcctgagcttcattggaaatacgggtattttatcgttttgggcgtcatggccgttcttgtcgccgccatgctgttttggttcgcccgcaaaggctggtttaatattttcaagtaagaacggctgccggctgttcttttttttgagaaaacatgatagtctggaaaaaaacgtaaagaggtgtgcgccgttaccatcctttctcataaaatcatttcttctgtcctcctgcttttcagtgtcatgtccattgccccgctgtataacggccgtacggtgtctgattacatctttgagtcgctcggcttttcttcctggtctgaagacggagcccatatctccgtcattcccggggtcgtcctttactttgcggcgttaatctggtgtgccgccgcgttcaggcggacgcttccctcggcggggctgtttctgatctttctcagtatgggggccgcttccggtatcagtcctgccaccgaatatgccgctttttccttaaaacagttcgcgcccgaaaaagagtctgtcgaatatttgaagcaccgcagcgaatgcagtcatctgattgaacgaaaaagagcgggcatgagctgcacgctttatatcaatcattacggaaaaggggaacaaaccatttctgtcacgccggatttatcagaaaacataaaggacgtcacattcaaatcaaaaacattcactgtaaaaccccgttcaaaaacaatcatcaaaacccgatttaccggattttataaggggacagccgcctcagactccggatggtcttcagaaccggaactgaaagtggcaatcctgtacacagcagaataaccattttgcatgtataatggtggaaaacttttcattggagggactgtcaaatgaagatcgccatcgtcggactcggcaatatgggccgccccatcgccgaaaatatcatgaaagccggatacagcctgactgtatataaccggacgaaagaaaaagcggctgacctgctggataaaggggccgaatatgccgaaacgccccgccaggcagctgaacatgcggacattgtgctttcaatgctgtcagacgatgaagctgtaacaggcgtgacgttcggagcttgcggcattattgccgggttatctgaaaacggcattcatatttcaatgagcacgatcagtacggcgctgtcagaacagctttccgccgcacattcgggcagagggcagtcctttattgccgctcccgtcctcggccgccccgatgccgccgagaaggccgagcttcgcatcatcacagccggaccggcagaagcgaagaaaaaggccgaaccgctgtttaacatcctgagtcagcaagtatttgacacgggtgaagaaacaaaaacggcaaatgccgcgaaaatcagcatcaatttcttgctcgtttctatgctggaggcgttatctgaatcattcttaatgatggataagttcggtttagaacaaaaacaatttctagaaatcgccaacgcactctttggctctcccgtctatcaaaattacggcacgatcatggctgaggagaaatttgagccggccggcttcaaaatgtctttagggctcaaggataccaatctggcgctcgccgccgcagaacaggtttccgcaaaactccctcttgccgaactggcgaagagccattttgaaagcgggatcgcacaaggctgcggagatttggattgggcggcattgattaaatgtatcaaataacaaaacacctctccattaccaggagaggtgttttctacaggcgcggcagcttcatttctttctcaaacatcaggtcatcaatgcttttaaacgtgtagccttcttttttcaaatcggtaatggcatcgtccagagcttctgaattgtcctttgaaacggtgtgaagaaggtagatcgcgccgggatgcgcctgctttatcatgtgatcataggcgtattgttttcctttttgctcgttaaccttccagtcgacaaatgcgacggaccagaaaaccgtttggtagccgagacgcttcgtttctttgaggacatattcgctgaatacgccgcgcggcggacggagatacaggttgtcccgctttccggtaatgttgtacacagcttccgtgacggaatcgagttcgtcttgaatctgatcgcccgtttttgtcgtcagatcaggatgatgaaaagaatgattgccgatgatatggccttcctttgacatccgtttaatcaaatcaggctgctctttcacaaaatgacccgtgacaaaaaaagtgcccgtgacgtgatgtttttttaacacatcaagcactttcggggtgtacccattttcatatccgttatcaaacgttaaatagatggtcttttctttcgtattgcccaaataaaaggcatcatattttttgaccagattgtccagctgtctgccggcatccggcggctgatgattgacgctgcgtttaaatccccagtttatccgttcattcggcaccgcttctgcgctgttgatgcctcctgcaagtaaaacggccatgcagcaaattgaacaaaaccatttcatgaccagcactccttctgcatttttccttattttgcagtaggccctgcccttttatacagccgcattatggaaaaagaaaaaccccggcatccgccgggggttattcccaatcctttttaaagcgttcgtattttgcttccagatcatcaagcatgccgatgagccggtctatatcttcaacgtccgttgattcagggtctaatgaatcaatgacattcataaacatatcgagtctgttcttcaggtaatcgagctgctgatctttgctgtttactgcattccccatacttccactccattcattttttataatggtagcgtattttttggcgtttttcaatggttccgctacttgcgatcttggcagatcaggtctaaaattaacagttggcagacgttagtatgcccatttataaaggagttagatagtcatgacacaaaacacagcactgcgtccgattacaccggagtacgatccttgggaagcgtacatggatgtcgaccagtatggagatatgaaactgacgaacgttgaattcacaacgacgactttgtgcaatatgagatgcgagcactgcgccgtcgggtacacgctccagccgaaagacccggatgcgctgccgatcgaccttttattaaagcggcttgatgaaattcctctgttgcgctctatcagcattacgggcggcgaaccgatgctttcgctgaaatcggtaaaggaatacgtcgtcccgcttttgaaatatgcgcatgaacgcggcgtgcgcacacagatcaattcaaacctgacgcttgatatcgggcgctacgaacggattattccttatttggacgttcttcacatttcccacaattggggaacggtcgaggactttgccgacatcggatttgcgatgatggagaagaaaccgacatttgaacagcgggcgcgctattttgataaaatgattgaaaacagccgcacgctggtcgaagcaggcgtaatggtttcagcggaaacgatgctgaacaagcggacgctgccgcatattgaacatattcaccggcagattacggaagaaatgaaatgccagcggcacgaagtccatccgatgtatccgagtgatttcgccagcgcgcttgaatcactcagcctgaaggacatgagacaggccattcatcatctgctcgacattcgcgatgaagagacatggatgctgttcggcacgctcccgttttacgcatgcagccctgatgaagaagaccagaagctcctccgccgcctgcgggaagcgaaaaacgttacggtgcgaaacgaccctgacggccgctcccgcctgaatgtcaacatttttgacggaaatatcattgtcacggatttcggcgatacaccgccgctcggcaatattaaaacagacagccttcccgatgcatatgacaagtggagacagacgaagctgagcaaagagctgaactgccgctgcacaaacgtccggtgcctcggaccgaacgtccttgtcaaaaacagttattatcaggacacggatttttcattacgaaaagccagaggttaacagaagatggaaacgacaattacggatattttgaaaagcaaagtggttgagatcatcatcgtcgctctcgtgctttacgccggtgtttttctgatcaaccgctttgtccaggtgttatttaaacgcatagatttcttggaggaacggaaagggaaaacgattgaaagcctcgtccgatccatcacccagtatacggcgacgatcggttttatcttttacgtcatttcgttattcgttcatgatttcggccgaattttagccggggcgggtgttgccggtatcgtcatcggtttcggcgcccagtcgttaatcaaggacatattggccggtgtctttttgatatacgaacgccagcttcataaaggcgattacgtgacgattaacaatctgttcaacggcacagtcgaagaaatcgggctccgttccctccagatccgtgagtggaccggcaagctgcttaccatttcaaacggtgaggtcagacagcttcaaaactataatattgattttatgcggattaccgagtccgtcgtgatcagttataaagaagatcccgagcgggtatatgccgtcttagaaaaagcctgcgacatgctcaatgatgagcttcgcgattcactgaagcgggatgaatttctcaatgcgacggagccgtttcaagtgcatggaatcatgagcctgaacaaattgacgagaggcatagaatttaccgtcaaaggcatggttcaagataaagaatacttctcggcaagccttgcggtgagacgcgttcttgcccgggagctgtacaacaacaatgtgcaattgcttgaggaaatgtatcacacacaaaaaagctgattcccgaaccggaatcagctttttttatttatctcggctgcgctgtcatttgaaaaccgaatgtgacgtgatcctgcaccggaatccaagccccgattccttgcgaagtcacatttttgacgacaagtttccgcttgctgcctttcagcaccaaatacacttcaccgtatgttacttttcctttttcattaacggccggagcgtaggcgtgcaggtagccgagccgctgcggagaaattttgtaggtttgatcgcgttttgtgcctgcgccgataaccgtttcaaacgcgagcggcagttttgttttcttcatcgctttttgcatcatcatgctttttacgtcttctgcgttcggcaccttcgctgtgagcccgcctttaattttgtactgctgttcttgggcgtatgagataaccgcggtttgctgtccgccccggttatccgctctgttcgtattgatttttttatattcccagttggcgaccgtttcgttcgattgatagccgagcgcccatttcccgagaaatattgtcgcccggtagccgatggcaagcggtgaaccggaaaccgaggattcattcagcatttttatcagatgcggattttcgatgttgatctcggatgtatctaacaattcctttgccagtttgctcggctgaagcatcggctggtcctgtgaagcattcggatacgtattttcctttgaaatgcttacaacagagttgggaaccttaaacggtttctttgcaccggcagacggcattgcgaaaaaactaaaggataacagcagaatcagtgtggcatgaaacagctttctcatcatatcactctttctatagcattttcctttagtcttttcctccgcaatcgttgttatccgcattttttacaggttaaagcaggaaaaaaccgatcgccatgatgacataagcggcaaggagcgtagccccttcaaaccagttcgaatcgccgtcatttgaaatcatcgtcatcaaaaggacggatgatatcatcgccacaagctcgggcaatgtgaatacaagcggcatattgaccggaaaaaagatagaacagatcacaagaaccggggctacaaacatggcgatctgcaaagtcgaacctaccgcgatttcaacggcgacatccatcttgtctttgtacgccataataatcgccgacgcatgctctgcggcatttccgacaattgcgacgataatcaccccgataaacagctcgctccagccgaactgttcagccaccgcatgaaacgtatggacaaggttttcagatatgtaggcgacaataatagttgaaataaataagacggctgtcgctcttttccccgaccactctggctgctcctcttcttcctttgcctccggctgattcggctgataaacaccgcggtgagtgacgagcttgaaataaagagctgccacgtacaaaaggatcatgatgatgctgatgccgacactcaaatcaagcttgtttttttcccccatatctatggaaaacacttcgggaatgacaaaagctacgataatggcaaaaatcagcaggcctgaattatgccgggcatcatgaatattgaattcctgccgcttgtatttcaaaccgccgataaaaaatgacaatcccgcgacgagcaaaagattgccgagcaccgaaccggtcagtgaagcaagcacgatgcccgtcagcccttcttttaaggcgaaaatcgatataatcagctctaccgcattgccgaacgtggcattcagcagaccgccgatccgcggtcccgcgataatggcaagagattcagtcgctctccccatataacttgcaagcgcaataatcgtcaagcaataaataataaacaaaaccgctgacggccagtgcatcaggccgccgatgactgaaagcggcactcccgccgcagccgtaaagaaaaaaatccgattcatatctgcctggctccttttttcgaataagtctttttatatccttctcaaaaactccttcaattacacttcctcggcagcccgaattggcattttcaggttgccggacgcggcaaatccgtgtacgatcaagaaagatactgaagaaggagaaatacgcgatgtcacgactgtacttctttattttggttctgcttgtttccatctccggattttcccaaggcatgcttctgccggtgatctccgtcatttttgaaacgaacggagaatccgcagccataaacggacttcacgcaaccggcctttatatcggcgtgcttctggcgtcgccgtttatggaggccccgctgcgcaagctcggattcaaacctctgatggtcatgggcggatttcttgttatcatcagcttattcagttttatttggcttcaatccatatggttatggttttttcttcggctgcttatcggaatcggggatcatatgctgcatttttcaacccaaacgtgggtgacttccaagtcaacgccccgaaacagaggaagaaacatttcgctgtacggactgtccttcgggcttggattcgctgtcggcccgttcatggtccctcttgtgaaaacaagtccgtcccttccgtttatcgtatccggctgtatcagtctttgtgcctggctgtttgtgtttgccttacgtaacgagtacccggcgcaaggtccggatgaaacatccggggacaacagcgcaaaacggttttaccgcgcccttcttttcggctgggtcgcttttctcccggctttcgggtacggttttttagaaacggcgctgaacggaagctttcccgtgtacgcccttcgtttaggcatatccgtggatgccgtcgcgctgatattgcccgcttttgccatcggaagtattgtattccagttccctctcggtttattaagcgatcgattcgggagaaaacgtgtcctgctcgtcatcttattaacgggtgccctttgctttttgacggccggactgtttccgtcgccttctgtcatcggctgctgctttttcacggcggggatggcggtcggcagtatgttttccctcggcatcagctatatgagcgacctgctgccgtcccatctgctgccggcgggcaacctgctctgcggcatttccttcagcctcggaagcatgatcggcccggtggcgggcggctggtatatgcagcggtttgaaagcgccaacttgttttactttattacggtgattctggtctgtatttggcttgcgctcgtcttcgggaaaacaaagcacagccccgcttccgaatcccattcttttccggccacataaaaaagccgcctgatctgagccaggcggcttctttctagtggtatccgttctgcccgttggcgcttccgcttgttttattcttcgggccgttttttgagttttgtttattatggcttccgccttttttcgtatgcttggtcatagccgattccctccgtttttcagcttgaacgtcatccgttcctctatagcttgctcccgcggtacggattttcatcaggaagctttttacgtttatgtaaaagcgcgttgatttctcctcctaaaatcaacaaggttcccgtaaggtaaaaccagatcatcaggacgataattcccccgatgctcccgtatgtggcgctgtagttggcaaaggtgccgacgtaaaatgagaacagcatactgacgataatccagccggctgccgcgaatacagctcccggcaggacaaaacggagggaaagctttttattcggcgcgaatatgtaaagcgcggtaaacacgattaaaaggataagcggactgataccccagcggacaaccgaccacacctgcaaaaacaggtccgaggcgccgatgaaatccgcggccagcattccgatttctctgccgaacaccggcagaagcagtgcgattaaaatcgtaaccaccatcgcaatggttaaaaaaattgaggtcaggcgaatgatgataaatgagcggttttcctcgacttcgtaggcatggttaaatgctctgacaatcgcgttcataccattcgaagccgaccagatgacggcgataatcccgaatgacaaaagcccgccgctgcgcttgttcagcgtttgctccgttatggatttcaccatggacatggcgctgtcgggcgcgtattgatcgaccgccccgagcacgtcttctgccgatatgggaagataggcggtgagcgtcagcatgaaaatcattaacggaaacaatgacagcaggaaaaaatacgccagctccgccgatttactttgtccttcatgcagagaaaaccttgcaaacagctcctttataaaactcatgacatcccacctcaatgatcgtttttcgaaaaatgctccttcgtttcttttaacaggtcaatgacctgcggtgtcgtctgcttcagcttggtgatctgcccgtttaaaaaactcagatcttccgatacggtattggcgaagattttcacttgatccatttttgcggaagcctgctgcttcagggcttcaggatgttttcggtaaaatgccgcacgccgcctgcacgcgtccatgttccggaaacatgcctctctcgtcggcttatgtaataaggacagtgctccgccggcggcagcgccgatcagaatggcttttgccatgatgcgtgtctgcttcatcggtcaatcccccttataaatgatggtctttctttattgtctccagcaaatgacggcacccggactcgaccaaagcgtacacctcgctgaaatttccggtataatacggatcgggcacgtcggcaaggtctgactccggtacataatcaagcagccttgcaatacgcggcgccgcttttttataaccggccatgctgcgcagatgtccgatattttctgcatccatcgcaatgacgtaatcaaaatcggtcagatcagactcacccgacctgcctcgccgtgatgccgcttgcgctgatccctttctccttcaggatctcctttgtcccttcatgcggcggatttcccgcatgccaggcgccgattcccgctgaatcaatgttaatctgcccgttcagcccgtttttcttcaccatatcagaaaataccgcctctgccataggcgaccggcaaatatttcccagacagacaaacagcacatgtatcatatcgataacctccctattctttccccgcattttgaggatcaaaaaccttatcaacatcttagcaatttttctgcggctgtggaaataagcttttattctaaatgaattctgttagaataaaggggacgaaaacgatcatgaaaggatgcatgaatttgccgagccaacaaacagaaacgttaaataaaatgattgaagacatttcgcaaaagctcaacatgctcaatgtcggcgtcatcagagcggaagatttcagtgatgaaaaaatagaagatcttacataccttcatcaaatggtcatgaaaaaagcatcattcagcccgagtgaaatgcaggccattgccgaggagctcgcctctctcaggaaataaacccatgtcagacctgccgaaaaacggcgggtcttttttgatttaaaaaagtaaaaaataaaagttcatcggtttgacacatataaaaagaaggagtatagtaactgtgaacttggtagaacgatatactaaatgagcgggccgcttatctttttttgtttagtagaacgatatactcattgtgatatcagcgttattcaagtttgtctatgcaaccgttgtatcaaacagttttcaaagaaaggcagtggttcaataaaggggtatggtgctgtgcttttatcaattaaaaaaataatttaattctttattaaccgcattaggggatgtcatcatgaaaaacatatacaccaaaatggcagcgggtctttatattaactatttcctgctgggcatgatcaatattattatcgcatccaatatggaggcattatcaaaacagcttcatacttccgcagccggtgtcagctatttggtctccgccatcgggatcgggaagctgatttcgcttctgtttgccgggaagctttcggatacattcgggagacggccgtttatcgtgtcgggcgcctttctgtatctgattttcctaatcgggattccgctttcgacaaactatacggccgcgtttatcttcgccattttcgccgggatcgccaattcctttttggattccgggacatatccggcgcttattgaaggatttccgaaaaacgcaagctctgcaaccgtgttaatcaaagcgtttgtatcaatcggcgcgacggtgcttccgttttttatcgcgtttattgcggacaggcatttgttttacggctggacgtttttcgtaccgggcattattttcttcctgaacggcttttttctgttgaaagttccgtttccgaatcataagcaaaaagaagacggcggccggacggaagcctctccgtctgatgacgcgttcacatcacagccgtcgatatggcgcgaaggcgttgcgatcattctgttaggcttttcatcaacggcgctgtttatgctcgttcaagtatggcttcctaagttcgggcaatccgttttgggcatgcctgaggtgcaggccgtcaaattgttgagctattacagcatcggggcgcttgtgtccgtgttattgctggctgtgctgttaaacagagtgattcagccgattacggtaatggtgctgtaccctgtgatcgcggcaatcgcgctgcttgctctgattttcattcagcagccggccgtatcggtcatcagctcctttgtcatcggactttcaactgcgggcattctgcaattggcgatgacggttatggctgttttattccctaaaaataaaggtacaatcacatcttttgttaatatagcatcaagcttatcttttattgtcattccgcttgtaacgggagcgatatccaaagccgccggcctgacgcctgtttttctgcttgatatcggaattgcggccgtcagcgccctcctcgcattgtttatcggaatccgctttaagcaagtgatgaaagcctgactattttttaagggagaggatttatcatgcaatctatcacaatcagaaacacggtcatcggtgaagggcttccgaagatcattgtgccgctgatggcggccggagagaaagaactgctcgaagaaattgaagccgtcaacaggcttcgcccggatatcattgagtggcgggcggatgtatacgagcatgttgacagcctggacgccgtaaaaggcatgcttgaaaagctgcggaaagccgcaggagcaacaccgctgcttttcacattcagaacccataaagaaggcggaaataaagttattgatgaccgcttttacattgaattgcttaaaaccgccatcgaaacaaaacatattgaccttgcagacgttgagctgtttacgggagaagcggaagtcaaatcaattgtgaaaaccgctgaagacaacggcgtatatgtcgtcatgtccaatcatgattttcatcagacaccgaaaaaagaagaaatcatttcccggctccggaacatgcaggcgtacggcgcgcacattccgaaaatcgcggtgatgccgcaaagcactgaagatgttttcgtcttattggatgccactcacacgatgaaaacacaatacgcagaccggccgatcatcacgatgtcaatggcgggaacaggcctgatcagccggctggccggcgaagtcttcggctcagcgtgcacgttcggagcgggcaaagaagcatcagcgcccgggcagattcccgttgaggaattgcgcagcgtactcagcattttaaataaacatatgtaatcagcgttttttgccctcaaagcgggaggaaaaacaaatgaatggactaacggaggaatacatcatgaagaaagaattaggacggattaacggaaaaactcagcttatcggattattcgcgacaccgatcggacactctttatctccggcgatgcacaacctggcgtttaaaaaattaggattgaactacgcttacctcgcgtttgaagtcggcaatgaacagctggaagatgtggtaacgggaatgcgcgccttaaacgtcagaggcttcaatgtctcgatgccgaacaagatgaacattctcccttatctcgatgaactcgcggattcagcgaaatttaccggcgcggtaaatacagtcgttaatgaaaacggcagactgatcggacactccactgacggtatgggatacgtccgcaacttaaaagaacacggcatcgatatcacagggaaaaaaatgacgctggtcggttccggcggggccgccactccgatagcgattcaatccgcattggaaggcctcggagaaatctctattttcgcccgcaatgacgcgtttttcgaaaaagcggaagaaaatgtccgcatcatcaatgaagaaatgaagggatcttcttgtaaagcgaaagtcttcccgctcgaagatcaagatgcgctgcgtgctgaaatcgcttcaagcgatattttcacaaacggaacaggtgtcggcatgaaaccgcttgaaggcttgagtgttattgaagatacatccatgctccgtccggatttgattgtgacagacgtcgtttacaaccccgttacgtcgaaattgcttgaacaagctcaagcagccggctgcaagaccattaacggtctcggcatgatgctttggcagggcgccatggcgtttgaatattggacaggccgtgaaatgccggttcagtatattaaagagcaaatgtttgaataacctattgtgacagaagcgccgaaggacaatccgtcttccggcgctttatctttttccccctcctctctctttcttctcatgcgccaaaacgcttataatggatgtaacgaataaaaaccaagtgaggaatgcgacgtatgaaacagcaaaaaaaacgccgggtgacattgcagcaggtcgccgaacatgccggcgtctcaacatccaccgcttcattaattgtccgcaataatccccgaatttccgaagcgacccgtgagaaagtgctgcaatccatgcgggagctggggtacgtatatgatcgggtcgccgcgaatttacgatcacagacgtccacaacggtaggattgattatcactgacatttccaatacgtttttctcagagtttctgatcggcgttcagaatacgcttgaggaagtcggattaacggtgctgttaggcacgacatttgattccgtcgccaagcaggagcagctgatctcgaccatgctggagcacagggtcggcggattgattttgtgtccggtttcagggacggctgaggaaaccctttcccgccttgagcagcttgacattccggtcgtgctcgccgtcagggagattgccgatgccaactgtgattttgtcggagccgattatgaggaaggcacctataaggcagtgcgtcatttcattgagaaaggccatcaggagattgcgtttctgggcggcgtgaagcactcatcaacatggacgaagcgtatgaaagggtttaaaaaagcactccgtgaagcggatctggaagtgaaaaatgaatatgtcattgacagcgcgccgacccgcgaagcaggctgtgacgccgtgacggagctcctccgccggtctgagcgcccgaccgcgattttctgcttcagtgatttggtcgcattcggcgtcatgcaagggatcagaaaagccgggctcgttccgggcgaagatattgacattgtcggctttgataacgtgccggaagctgaaatttcttatcctccgcttacaaccgtttcttcctttccgcggcagtcgggaaaagaagcggctcaattgctgcatcataaaatcaccaattcccagcacaaaaaacaacgcattattctggcgcctgagctggtcatccgggaatcttcacaaaaaaagcggaacgcctgatacggcgctccgcttttatattacgcaagcagttttaatgattcgcggttgaatgccggaatgtcatccggtgtgcggcttgtgaccagctggttctggcagacgacgacttcttcatccaccacattcgcgcccgcgttttccatatcgattcggattgaagtaaatcctgtcgctttgcgcccgtccaatgctttcgcgttgatgagaagctgagggccgtggcagatagcgaacaccggttttttatcatccataaacgctttggcaaattggacgaaacggtcatccgcacgcagcatgtcaggtgagaatccgcccgggatcagcaatgcgtcaaagtctttcggattcacatcatcgatggacgcgtccactttcacttccgcttccccttgttttcctttgactgtttttcctttttcctgttcaattacggttaattcatgacccgcatctttaaaagctttcgcaggttcagtatactcgacatcctcaaagtaatccgttaatacaactgcaatttttttacccatagttactacctcctgcttgatgaagtctacataaatccatgtaccccagccacactaacatcaaacataggtaacgcgtttaccgcccgcctgttttacataggtcattatcctcattttttatcttttcacaagaatcatcatgaaatctatataaactttcacaaaatattcttacaatggtactgcatgacaaaatttgttgaaaggtggagaacaggtgagaatacagaaaagacgatgcagcgtcaatatgacactccgtattctgctgcccctagttatgatacttagtctgatcctcccaacatcacccattaaagcagaagaaaacaaatcctccagtgtgaatctcagcattttagccacaactgacgttcacgctaacatgatggactacgattactacagcgacaaaccgacaacggaattcgggctggcccgaacggctcagcttattgagaagcacaggcgcgaaaacccgaatacggtgcttgtcgataacggagacctgattcaggggaatcccctcggagaatacgccgtaaaatatgagaaaaatgatatcatttcaggcgcaaaaacccatccgatcattgaagtgatgaacagtctgcattatgacgcaggaacactcggcaatcatgaatttaattacgggcttgaattcctggacgggacaatcaaaggcgctgattatccgatcgttaacgccaatgtgaaaacagtaagcggcgaaaaccgttatacgccttatgtcataaaagacaaaaccgtcacggatgaaaacggcggcaagcatcagctaaaagtcggctatatcggctttgttcctccccagatcatgacgtgggataagaaaaatctcgaaggccgcgttcaggtcgaggacattgtggaatccgcaaagaaaaccgttccgaaaatgaaagctgaaggagccgatatcgtcatcgccctcgcccacagcggcatcgaaaaaaaagcgcagtcttccggagcggaaaacgccgtttttgacctggcaacgaaagtcggcggaattgacgcgatcgtatcgggccatcagcacgggcttttccctgatgccgaatacaaaggcgctgctcaattcgacgtcgataaaggcacgattaacggcatccccgttgttatgtcaagcagctggggcaaatatgcgggcgtcatcgacctccggcttgaaaaaacagacagcgcgtggcatgtggaagatgcaaaaggcagcatcgagccgattgccggcaatgtgaattcggaaaacgaaaccgtcgtcaataccgtcaaaaaagcgcacgaaggcactttgaaatacatcagagaacccgtcggccagacaaaagccgatatcaacagtttcttcgcccaagtcaaagatgatccgtccattcaaatcgtaacggatgcgcaaaaatggtacgccgaaaataagatgaaggatacggagtacaaagatctgcctatcctctcggcgggcgccccgtttaaagccggcgggcggaacggctcaaactactatacaaacatttccgctggcgacctcgccatcaaaaacatcggcgatttgtacctgtatgacaacacggttcagatcgtcaagctgaacggaagcgaagtgaaagactggctcgaaatgtccgcggggcaatttaatcagatcgatcaggcaaaaggcggcagccaagcgcttttaaatgacgcctaccgctcatacaattttgatgtcattgacggtgtcacctatcaggtcgatgtcacaaaaccggcgaaatacaacgaaaacggaacagtcattcatcccgatgcaagccggatcgtcaacctttcttatcaaggaaagcccgtcagcgccaagcaggaatttctgatcgtcacaaataattaccgcgcttcaggcggcggaggattccctcacttaagcaatgacaaaatcgtatactcttctgccgatgagaacaggcaggtcttaatggattacatcatccagcagaaaacgattaatccgcaggctgatcataactggtccatccttccggtcaaagggacaaatctgacatttgaatcttccttggccgcaaagccgtttgccgaccgcgcagatgacgtcgcctatatcggtgaatcacaaaacgcgggctacggacagtacaagctccaattcaaagatgatgaaccgggcacagatccgccgaaagatgacgcatggaaactcaccgttatgcatacaaatgacacgcacgcccaccttgataacgcggcgaggcggatgacgaaaatcaaagaaatcagaagcgaaaccgaccgcagcattttgctggatgcgggagacgttttctcaggcgatctctatttcacaaagtggcaggggctggctgatttaaaattgatgaacagcatgggctacgacgcaatgaccttcggaaatcatgagtttgataaaggtccgggtgctctcgccagcttcttgagcggtaacgggagcgcgtctgacccgtccgggaaatacaattttcaagcacctgactttccgctcgtcagctcaaatgtcgatgtgtccaaagagtcaaaactcagaccattcatgaaaaaagcagacacatttacggcagggaaaaagaaaaaagcaggcatctatccatatattctgcttgatgtaaacggagaaaaagtcgccgtattcggcttgacgacagaagatacgtccgtcacatcaagcccgggaaaaagcattgtctttcatgatgccttccaatccgcacaagatacggtaaaagaaatacagaacaaggaacatgtcaataaaattatcgccctgacccatatcggacatcagcgtgatctcgatctcgccaaaaaagtaaaaggcatcgacttaatcgtcggcggacatacgcatacgcttgtagataaaatggaaattgtcaaaaacgaagagccgaccatcgtcgcccaggcaaaagaatacggcgaatatttaggccgtgtcgatgtcgcatttgacaaaaacggcgtcgtcctgccggaacaatcctctcttcaagcgctgccggtgaatgagcagacgaaagaagacccggatctgaaaaaagagcttgatccgtttaaaaaagagctcgtctcagttaaaaatgaaaaagtcggttcaacgaaggtcgcacttgacggccggcgcgagcatgtccgctccaaagaaaccaatctcggaaacttcatcgcggacggcatgctgcaaaaagcgaaggaagcggccggcgcccaaatcgcgatcacaaacgggggcggcatccgcgcgggcattgataaaggagacatcacactcggcgacgtgctgaatgtaatgccgttcggcaacacgctttacgtcgcggatttaaccggaaaacagatcaaacaagccctggaacaaggattaagcggaattgaggctcaaggcggcgccttccctcaagttgccggtttaacatacacgtttacactgaataaaaagccgggacaccgtgttcttcaagcttcggccgtacaggatgacggcagtgtaaagccgatttctgataagaagacatacagagtcgccaccagtaactttgtcggtgaaggcggagacggatattccgtctttaacgaagcatcccataaagaagaccttggctttgccgactatgaggtcttcgttgagcagcttgaaaaagcgggaaaagcggtggaaccgaaagttgacggccgcgcgcaggaagtgtacctgccgacaaaacaaaaaaacggttcgtggacgcttgaagatgacagcgcatttgccgtctatgccaaaaacgccaacacgccgatcgtgtattacgataagaatgacggcgccaaaaagccgattgatctcagcgtgaccaaaaaacaaatcggcctgttaaaggacagaacatcggattcttcccttacgatcctgcatgacaagttcagcatgaaaatgccgatggcaaacgccgcttcagctgatacacgattcggcgtggcgccgaaaggaaaagttagcggggcgctttcaaatgtatacgactttacaatgaagcagaaaaacaaagacatcaaaacattcaaagcgccggtaaagctcaccctgcgcattgagaatatgaaaaaggcgaaacagcccggcatttatcatgtagaccggaaaaagaacgtctatacaaaaacagacaacggttcggtttcacacgatctcgtcacgggctatacaaatcatttcagtgaatacaccatattaaacgcaaacacgaagagcgcgccgccgacaagcggagatcacggctccggaaagcagccaagcggacaaaaaccgtcatccggccctgcgcaggacggagtatcgccgggcggcctgcttcctgatacagccacaacgatgtattccatccttcttgccgggttactcatcagcgcgctcggaacggcactgtatctgtaccaaagaagaaaagcaaaaaaagtgaacgaagcataaaaagaccgcttttatcgggcggttcatcccaagagctctcctgatctgatatcaggagagctttttctgccggtcccctctgagtcgacagccgtacggccgagtgataaaatatgaacgttattcgcgaaagactgcatccgcatcgtttaacacttcacggcggagcctctcttttacacggcgccgcctgtttggaggactttttttgaagattacaggaaacaaacgaaaccgcatgtcttacaagaaaaagctgttttacgtgataacagcgctttgttttatcagctcgatcatttttgtcactcacaacgcttctttttatgagcggccgattgccagagtgacgaaaacaactttggaacaccaggcaaacgtacaggacatgcataaaaacaaagataagattttcaatcagacgatcactgccagacttgaaaacggcagtcagaaagggcagctcattcatttgtccaatcagtattctttatccggagcgaatgatcagaaatattcgattggcgatgaagtattcgtttctattgataaagggaaaccatcaaacaaagatatatcgggaagcattatagataaaaaacgggataaacagcttttgctgatcgcttgggttttcatcttcaccttgcttatcgtcggaaaaaaacaaggcttcttttcgatcgtcagcctgatgtttaacgccgttttactgtcgtttgcattagatttgtacaggaagcatcctaatatagggttaatttttatctgcggtatctgtattctcatctttacggtcatctcattgctgcttgtcagcggttttcacgcgaaaacatatgccgccatagccgcgacgctcgcaggcactttcgtttccctgctgattacgtatctggtgatgctggcaaccggagagaaaggtctcagatatgaggaaatgcagtatttaacccgcccttatcacacggtgtttatggccggggtatttatcggatcactgggagcggtcatggatgtagccattaccatgacgtcatctgtcttcggattatatgaagaaaacaagggtatctcattacaagctctcagacgttccgggatggagatcggaaaagacatcatgggagcgatgaccaatattctgttttttgcttatataagcggctctattccgatgatgcttttgtatttgaaaaatgattccccgataggattcactctttctatgaacatttccttggaaatagccagagcattggccggggggatcggaattgtattaaccatacccgccagtctgtatgcttctgtcttttttattaaacaaaagaaggcaagctcatgaatgtcatcgtaattctcgcggcgattttatttctattaatggtcattatcggcggaaaaaaaggagcgaggtcttttattgcgttattcttaaatttcggggttctctttctcaccattattttcatgacagatccgcatatcaatccgattgttttaacattgctctcttccgccgtgatttgcagcattactcttttttatattaatggaggaaacgtcaaaaccgtaaccgcctttatttctgcgatgctgaccattgcattgctgctgttttttattatgtccgtaacaaaacatacttcgattcagggattcggtgaagaagaattgggggatatcggcatattcacactgtttgtcggggtggattttgtgaaggttaccgcagctatgatcatcatgggcacgattggggcgattactgatgtcgcgatttccattacttcacccatgcgggaaatttacagtcataatccgtccatgagcagaaaagaactgtacacattcggattaagcatcgggagagatattttaggaacgaatacgaatacgttattctttgcttttttcggcagctatttggctttaattatctggtttaaagacttatcatactcagctgaaaaaatagtgaactcaaaagtattcagtgcggaagccgtcaccattctttgcgccggaatcgggatcggcatcatcattcccgttacgtcctggatcaccgcctgttttttagcaaaaccaaataaacattaaaagctgccgggacacgcccggcagctttttttatcttatacccactttacaacgtcttttgaggcagatcttgttttcgggcgcggttctctgacacggtagccgaatgcggccatgacagagatgtcgaaacttccgttttccagaagcccttcttcttcaagaatccggtggatctctttgtagttgaagccttcaacagggcaggaatcgatgccgatctgcgcagcggctgtcatcatattgccgagggcgatgtaagtctgtttggatgcccagtcaaacagcgcgcgatctgattcaagcagattgaaatcatttttctggaagtcttccgttttgctgatatagccttcatacatatcttccggcatttttttgacttcccgcaagtggtttttgacatagtcggcgtcaaaacggatatcctttgccgtccgggcaagcagaagtacgaaatggcttgcggtcggcagctgcttttgcgccccccatgtgaactcgcggagtttttcacgaagctccggattttgaacgacgacaaatttccaaggctccaaaccgagtgagcttggggataatcttcccgtttctaaaatgaattcaaaatcgctttctgaaatttttttctcaggatcaaattcctttgtagcgtgtctgaattgatacgcttcgatgatctgctgttttttatctgacattcatgatctctcctttttatctcgttatgtactattgtagccattatttttgaaagtaccagtacgcacatttttgttggatagtattcattttgatactgacaaaaaaacgggctgccgcggcagtccgtttttatttttctcttctcgcaaagtcgacgaaacggaatttatcgagcctgtgccggctttccgtgtactgaaagaggctggtatcctccaaaaagacgcggtttttcacgaccgccatatggctgaacccgccgagatccaaatacttccggtcttcctcccccgccggctccacgacaatttccttttgcgcgtagctgatggacaggccgagctctccttcgagatactcatagatcgaatcttcacaaatcgccttcgttaatagaggcacatgttttttcacaaagtaatccttgtccaaaataatatgttctccgtcaatccgtcttgatctgacgacttcccacaccttttcatccgccactgtaccaagctcttttgcggcttctgagggaggcaggatcagcccgagacggtgaacctccgttcgcgtctcttttccgagcgtttccgaaagctctttgaagctgatcaggcctgagacgggaaagcgcattttttctctgtctaatatgacggagcctttgcctttgattttctggatgtagccgttttgcgccagcatattgagcgctttacggacggtttctcgtgatgtgccgtattgatcgcataaatcattttcagacggaagaacgtcttcagccttccgctggccgctttcaatctgccgcaccatatctttatagattgtgatatatttattcactttcattcatgaccacccagattagtgtatcacgcttttgtcagatgataaacgatcgattcatacggacggagcgtcaatcgttccggccgcccttccctcggttcatcattcgtcagcagcaccgtaaaccgccagccgtccgtgtctttaagcggaaccgtaaagtccgcttctttcccgtagaagttgttgatgcacagaagtttttcatccttgccgtgtctgacgtacgccagaaccgccggatcatcttcagcaagcagctcaaacgttccttcagtcacgatgtcatattcctttctgagcttgatgagcttctgataatggtagaaaattgaatccgggtcccgcaaagccgcttccgcgttaatgtcccgataatcatccgccgccggaatccaaggcgttcccgtcgtgaagccgccgttcggcccgctgttccattgaacgggggttcttgcattgtctcttgatttctcttttaaaatggcgataatgtctttttctgacacgccttcttccttcatctttttgtaaatgttcagtgattcgacatcgcggtatgagccgatgtcatcgaacttcggattgcccatgccgatctcctcaccttgataaatgtaaggcgtgccctgcatcatatgaatggccgccgccagcattttggctgatttcgtccggtatacgccatcgtctccgtatctggatacggcccgcggctggtcatggttgcaccagaataatgcgttccagcctccgccgttttgcatctccgtctgccaaaacgctaaaatccgtttcagcttcagaaaatcaaacggagcgagcgcccatttttcaccattcggataatccacttttaaatgatgaaagttaaaggtcatatcgagttctttattttcagggtttgtgtaccggatgcagtggtcagccgttgtcgaggacatttcaccgaccgtcatgctgtcatatttcgaaaacacttcccggttcatctcatgaagaaattcgtgcacgcgcggcccgtccgtataataagggcgcccgtcacgaccatcctcggcatcaggaaacgattggtctttagaaatgaggttgatcacatccagccggaagccgtcgatcccttttcggaaccaaaaatgcatcatgtcgtaaacctgttttctcatctcttcattttcccagttcaaatcggcctgcgacacatcgaataaatgcagatagtgctggcctgaggccggatcgagctcccaagcggaaccgccgaattttgattcccagttgttcggcgcccggccgtcttccttgccgtctttccaaatgtaaaaatcccgatacggactgtcgggtgacgaaaccgcttctttgaaccactgatgctcgactgatgtatggtttacgacaagatccatgacgacctttattcctcttttgtgcgcttcatcgagaaggcgttcaaaatcctccatcgttccgtattcttcataaatggtgcagtaatcgcgaatgtcataaccgttgtcattctgcggcgaatcgtaaatcggcgtaagccaaatgacatcaatcaaaagcttctgcaaataatcaagcttctcgataataccgttcagatcaccgatcccgtttcccgtcgtatcattaaagctcttcggataaatttgatataccgctgcctttttccaccatggtgtgctgtctgttttcatttttcttcaccgcctgtattgttttgaatggaaagggaaaagggacagcctgttagaaggcgccccgcaggttttctatttttgccgtttcagccgcgcatacccgtatgttcccgcaaacgggagtatcagcacgatcagcattccgatcgcaaacggaccccagtaccggctcataatggagaagatccccgggacgccgccgactccgaccgagcttgcgagaacgcctttgacggagatgaacatccccgcaatccccgagctgatcatggcgatcacaaacggaaatttgtaacgcagattcacgccgaaaatcgccggctcggtaatgcccaaatatgcggaaatgccggccgtcagtgaaagcccccgctgttttttatcttttgtaatgagcatcatggccagagccgccgatccttgagcgatatttgataatgcgagcatcggccataaaaatgtgccgccgagctttgatccgattaattgaagatcgaccgcgagaaacgtatgatgcatccccgtgatgacaagcgccgaatacagccctccgtacagcaggcctccgatggcggagaattggccgaaaacggcaatcaatcccgccgtcagcgcgttaccgatcgcaaaggtgatcggaccgatgataacaaaggatagaaaaccgatgaccaaaagcgtcaccggcgcgacgaccaacagctgaatgccctccggcgtccgtttcgtcaaaaagagctcaagcctggcaagtaaataagacgccagcagaatcgggagcacctgaccttgatacccgactttctgcacctcaaggccgaacaagttccacaccggaatatcgccgctctgctcggcggccccgtatccccatgcgtttaacagatcaggatgcaccagcatcagcccgagcacgatgcccaaaagcgggcttcctccgaaccgcttcactgccgaccagccgattaaagccggcagaaaagcgaaggccgtccccgcgatcagattaatcatattggcaagatccgcccattgcggatacacttgaacaatcgatttcgtgctgtaaaaaatgccttccgccgttaagatattgttcagacccattaaaagcccggccgtgacgatcgccggcaagatcggaataaagatgtccgcaagcgttttcatagcacgctgtaaaggattcattttttgcgatgccgccttcttcacgtcatccttggacgcttccccgatccccgtttccttcactaattccgcatatactttgttgaccgtcccctgcccgatcacgacttgaaactgcccgtttaccgcaaaagatcctttgacaatgtctattgcatcaagcattttttggtttaccttggtttcatctattaatgcaaaccgcaaacgcgtcacacaatgagtcgccgcctcaatattttcgattccgccgacagcttcagcgatctgccgcgcagcccggttaaactcacccatgccaacccctccgtaaccgttttcattttgtctcaaaaaacttgtatatacatgtttatgactctattgtaatgatgtatatacatgtcgtcaatctatttttatagcgctttcatcacaaatatactgcgaaagaccctgaaacaaaaaaagccccgccggaaccgggccttgacttcttgtttggtcgggaacatgtccgggcggaattcacaacaggagcacaaaaagcatacagtactgtacaactaagttaaagaggtgtgaagagatgccatccactgttatcaacctgtactatttgaagattaacagtatttctggcaacggatctattacgattggggaagcggcatacaacagtcccaccacaaataacaaatcacaaggactgaactcttcattcggcgatacgtcacctatagaatcgatgatggagaacttgttaaatgatcctgatgtcaacgaccagacagccatcggaaccgcagataccgcaaatattacgccggtgccgcccattatagattaaaggggtttttatgaatgccttaccaaattaacgtcgtcaatataaaagtaaacggagcaacgcaaaacggaaacgtcgatatcggtcagaccgtacaaaacagccacaccgccaacagcaaatttgtcggcgcgaacttttctttaggggatttttcgccggccgccggatgtttgaattcgggccatcttgaccctgacgtgagcgatcaggatcagatcgccaacccgtcaatgccgatcgcaaatcaaatatagggaggttctgccgaagtggatatcgaaaaaatgagaaagtggcttgagattacgaacgagcacaagcccagcgacttttggaccaatgtcctgaaacggaaatctcccgaagattttttctccttacaaaaaaacaccctgacttatgatatttatcaggatgaacagcacacatttgtcattgtggaaatgcccggcgtttacgaagaagaattgacattgaggctgctgtcaagaacacggctgcatataagaggaaacatcacacccctttttccgaagaacatgggcgtctgccaaaaccggtattacggggaaatcgatgagacgattgagcttcctgaaccggctgagccccacctgttacaggcgcagtgcgtaaacggcctgctccacatttcctacccgcgccttatggagcacattccttttcagaaaaaaatataaagagccggcttacgggcggcccagccgtctgtacactttctccttataatgagaagatgcgggttttgagaacatggctttctcctccgtcagtttgtcgagtctgacttgtttttccgtccgtttgttccgcaggtgatcccgctcctgttcattgcggcacttggcgatcaaataatcgagcgtcatcagctctttcttcagcgcgccctcatcctcggcgatcccggcgttttttaatatgcggtagcccattctgagcgactccggaagatgtgcggcatcgtctttcggcaggggctttcccattccattgatgccggcgaactctccatccttaatggcgcgcttgattttatcttcagccacgatatgcgcaatatccatcactgtttacctctttcttcaatagaatcgggtgtgatcatacggaaattcacatcccagtttgtgccatttgtgttttttaaagctgtcattcaacagatcaaccgccgctgcgacagcgtttttcgccctttttccgatgagccttttccaccttttctatttgctggtttcatggtatattgattacgttcgttttttctatcgttccgtgtaaaccgtgatcggaaaaaaggagtgtaacaatgaaaacatttataaaagaaagaggacttgccttcttcttgatagcggtcgtgttattgtgggtgaaaacatatgtcgcttatattttaaactttaacctcggcatagacaacacgatccagaaaatattgctttttgtgaatccgctgagctccagcttgttctttcttggatttgggcttcttttcaagaagaaattacagcagacagccattattgtgattcattttttattgtcttttttgctttttgcaaacatcgtctattatagattctttaatgatttcattaccatcccggtcatgatgcaggcaaagacaaacggcggccagctcggagacagcgcgttctcgttaatgagatggacagacgccttctacttcctggataccgtcattttgattattttggcccttaagatgaaaaaaccggctgaaaaaccggcgaagaaatcattcagaatcgttttggcttccgccgtgcttgtgttcctgatcaacctcgccgtcgcggaatccgaccgtcccgagcttttgacacgctcatttgaccgaaactatctggtgaaatacttgggcacgtacaactttacgatttacgatgccgtgcagaatgtgaaatcaaacagccagcgcgcgcttgccgattcaagcgatgtaacggatgtggaaaactatatgaaggccaactatgacgtgccgaataacgtctacttcggaaaagccgaaggaaaaaacgtcatctacgtctcattagagtctctgcagtcctttatcattgattacaaaattaacggcaaggaagtgacgccgtttttaaacaaactggcgcacgataatcaaacattctactttgataactttttccaccaaacgggacaaggtaaaacatctgatgcggaatttatgatggagaactctctgtacccgctttcgcaaggttcggttttcgtcaataaagcgcaaaacacgctgcagtccgttcctgcgatcttaaaaggcaaaaagtacacgtctgccgctttccacggaaatacgcagactttctggaaccgtaacgaaatgtacaaatcggaaggcatcgataagtttttcgattccgcttattatgacatgagcgaagaaaatacgaaaaactacggcatgaaagacaaaccgtatttcaaagaatccatgccgctcttaaagagcctgccgcagccgttctatacgaagttcattacgctgtccaaccacttcccgttcggaatggataaagaagacacggacttcccggcgggagactttggcgattcagtcgtcaataattacttccagtccgcgaactatctggatgaatcaattgaacagttctttaatgacctgaaaaaagacggcctgtacgataagtcgattatcgtgatgtacggagaccactacggcatctccgaaaaccataataaagcgatggcgaaagtgctcggcaaagatgagatcactgaatacgacaatgcccagcttcagcgggtgccgctctttatccacgctcccggcgtgaaaggcggccgcaatcataaatttgccggtgaagtcgatgtcgcgccgaccgttcttcatctgctcggcgtcgatacgaaagattatctcatgtcaggttctgatatcttatcgaaagagcacagagaagtcattccgttccgtaacggagacttcatctcgccgaactatacgaaagtgtccggcaagtattacgatacgaaaaccggaagacttttagatgattcagaagtcgacaaaaaagaagactctctcgtcaagactgagcttgaaatgtctgataagatcatcaacggcgatctgcttcgtttctatcagccgaaaggcttcaagaaagtggatccgtcacaattcgattatacgaagcgtgaagattcctcagcagacgatcaaaaagaataaacaaaagccagatcattgatatgatctggcttttttatgttcagctcccggcggcggccatagtgcgcttttgcaggctgtcggaaagaactgaataagcgattactttctttttctgctgcttgacgacatctacatgatcttcgtagctgtatacaaacaccgtcacatctttttttccttttctcgtcttaatgacaagcggatcggctccgttttgcggatgaagataacgctcttcatcccctgggtatatataatgccgttcgataaacacggcttcgttaaaatcatcaatcacccgtcgtttgtcttcgccttccagacgttttcccccgagggaaacggcagcggactcgtcactgagctttgaatgggtttcaaacttgcggaggatccattccaccgctccggtaggaaggcatgtcagcacaatcttaatcaggcttatgacaacaattgaaacaactgcaatccatgtcaccttacatcatctccatacttgttctacatgaatcttaacatagaaggaaacattgttttttgtacattatgtgaaacttgatatatgttcaaaaaaaatccggatcacataggtgatccggatttttcaagtctgcttctgatcgtcaaggcggacggcctctctcagctcttccgcgacaaattcgacgttcggcccgataatgacctgcgccgttttattccccgttttgataaccccttttgctcccgcttttttaagcgccgcctcattaatgagagacgtatcctgcacggtcagcctgaggcgggtcgcacagtgatcaatcgtttcgagattttgcctgccgccgagccccttgagcatggcatgttcttcgacggaaccggccgtatcttcactaagcacttcttcctcttcctcatcatcttcccgtcccggcgttttcaagtttaacgttttgatgagcatataaaagacggcaaaatagatcaccgcataacaaagcccgacaacgagcagcaaaagcggtttttcggcaatgccgtagctgaggagataatcgatcgcccccgccgagaatgaaaaacctgacctgattccgagaacattcacgataaataaagagaacccggttaatatagcatgaaccccgtacaaaagcggtgataaaaacataaatgcaaattcaatcggctctgtaattccggtaataaatgccgtcagcgcgagaccgatcatcattccggccgtcgctttgcgcttacttggcttagccgcggcaatcattgccagacaagcggccggaagcccgaacatcataatcgggaagaatcccgtcatataagtccccgccgtcggatccttcgcaaagaagcgggccagatctcccgtttttccgtgaaaatcgccaaactggaaccaaaaaatattattcaacacatgatgaagaccgaatggaatcaaaagccgattaaaaatcccgtaaatccccgcgccgatcccgccaagcccgatcatccattccccgaaggacgtaatcaccgactgaatcggcggccacacaaatccgaagatacccgccaaaataatggtaatcagcgccgttacaatcggaacgagcctgcgcccgctgaaaaacccgagatattcgggcagcttcgtatccttaaagcgattatacgtgtatcccgcaattaaccccgcgataatccctccgaaaacggccatattatttgtcgaattgattgattttacagccgcgtccagcatgatataagaaatggctcccgacagagcggcggccccgttgctgtctttcgaaatcccgatcgcgattccgatcgcgaaaatcagcggcagatgatcaaataccgcggtccccgccgcgtaaatgaacggaatatttaataagtcctctctgccgatggccaaaataataccaacggcgggcagaacggcaatcggaagcataaaagactttccgagtttttgcaaaaattgaagcattttacccatcccccttcttttttcttaaatataccacataagttatctagtgatctataccaattttccttcatttattcacataaggcttgttggttttctatttataaaccagttgtggtaagcttgaatcagatgattaaaaatagaaagcgggaatgacaatgattgtaacgaacgatcaagaattagaaggccttaaaaaaatcggcagaatcgtcgcgctggcgcgtgaagaaatgaagaaaaaagccgagcccggcatgagcacgaaagatcttgacctgatcggaaaggcggtgcttgacgagcacggagccgcttccgctccggagaaggaatacgatttcccgggcgtgacatgcatcagcgtaaatgacgaagtcgctcacggcattccgagcgcctctaaaatcttaaaagccggagatcttgtcaatatcgatatttcggcggagttcggcggtttttattccgatacgggcatttcatttgtgctcggagaaggcgatgaacgtctgcaaaagctttgtaactgcgcggcatccgcatttcagaaaggattggatcaggcaaaagccggcaaacgtcaaaaccagatcggcagagccgtctaccatgaagcccgctccaacggatttaccgtcattaaaacgctgacgggccacggaatcggcagaaacctccatgaagcgccgaaccacatcatgaattactacgatccgtttgataacgcgctgtttaaaaacggaaccgtgatcgcgcttgagccgtttatttccacgaaagcggaaacgattgttgaagcgggagacggctggacatataaaacgccggataaaagccttgtcgcccaagtggaacacaccatcgtgattacaaaagacaaaccgattattttaactgcattgtaatgtttcatctccctcccgaacaggtatacaacaactaacccgaaggagggagacgcatgaaaaaagataaagaaaaaatcaaaattgaaaacgaaatacacgccatgcacggcgtaacgaaacagcagattttagaggatttcgaggaatttaaggcgtaccttcatcagaaaatttccgccggaaaaaaactgggtctggatgacagcaaaatcatcaaaagcgccgccatcctcggggactatctcgccaaacacgaggagccccgcaatgcggaagaaaaactcttacaagaactgtgggacatcgcggatgataatgaaaaacagcatttggcccagcttctcgtcaaacttgccggacactgatacagtgcccggcttttttatgctccgttataagagttgtgctacactggacatatgtctgtgaaaggagccatttttcaacatgtggtttattatcttcgggtttattttctttattgaaagcatcattctcaccgtttacggggtgaagaaaaagaaggggatgctgatttatttcggcgtcgttttcggaatcatgacactcggaacggtgctgttaaaattaaccggccattaagcatgaaaagaccgccctttacatatatatgtaagaaagctttacatctctgaatcgaaaggctcagtttttgcattatcccttttcagcgtctttttatagatgttacaatgccaaaagtttggcaaaaactgaagaaacctccccagcgggagaacggagaaaggagttttctgacatgcattatggcagtaaaggctggtatgtagaagagttaaagaaaaaaggaattacccactatgaaggaagaaagcttcaaagcttcaaaaagtacttccttgccaatctgctggaaacaaagaaacaagcataacgtaaatcagccgtgctgtcagtgcagcacggctttttttctatacattagtgagcctgtccctttttttaaggaaggactccctccagctttctgacagcgcttcttcccgcagtatttcttcaatcgctgacagattgtctgaatcacggtatttcacttcgttcgcataccagacggaaatgctttctttgcctctcgacagacgcttgaggacgggacgcggatcgacatatccttcttcaagcaccctgaaataaaagccggtaaatcccgtctgctgtacacggagcaccatatctttgatgccatatttgagcgcgagtttgacgcagggctggcgcggctggcttacttgaacgacggcttcacccagctgaaagatgtcgccgatccacacgtcttgttcggccagtcctttgaccgttacattctctccgaacgcggcggcgggaagttttctcgcgagcgttgtttcccaatatgaataatgctcggcgggatacacgcacaccgctttatcgggacctccgtgatgcttcagatcagcctgcccgtccccgtcaaaatgggttttatacagcatgacgggagaatctgcgggccgcttgatgatgcctgaattgatttgtctgccggcaaattcatgaattgcgggctttccgagattgatagataagacagaatagtcttgcgtcatctcgttcacatcctttgcgaaatatcctacctttcctttatcatagtaagaaaaaggtggtttttccatgcttcagtatcatatgattgcagacggccgggttcagggcgtaggttttcgctacttcgtccagatggaagccgacagacataagatagccggctgggtaaaaaaccgtgatgacggccgggtggaaatccttgccgaaggccctgaagagtcgttaaaacaatttgccgaagcggtcagaaaaggcagccccttctcaaatgtcacaaacgtaaccatcgaagaatcacaccgtctgaaagggtaccgcaccttttccatcagttactgataaggcttgtcctgataaaaataattcggcttcacaatcgtattgtcatatgatttatggaaaatgtgggtggaagccggcgagatcggcggaatcagccaggtccagtcgcccgtcagctttctgcccgcgtcttgttcctgttcttcaaagcgtttaaattgattcgcggccgtatggtgatcgacaatgctgacaccgtgttttttgtatgaatagagcactgccttattcagttccaccagcacctgatctttccacaggtcggtattcaggctggcggaaatccccatgaccgaagcggcttttttgagcatatcataccgcttttcgtcagcaaggttccttgcgccgatttcagttcccatataccatccgttaaaaggcgccgcgttgtacgacagtccgccgatttcaagcctcatatcggcgataatcggaaccccgtaccacctgagatttaaatcggcaaactcttcaatatccggatgggtgatcggcacttctttcacgagcgtctgaggcaggtcataccagaccggctgcccgtcccctttcatccggaaaagcagcggcagaatatcaaattcggtccgcttcccgcgccagccgagtttttcgcagacagccgtcagctcatatgatgccggatcaccgactcttcctttttcagtctcatatcccgcatagcggatgagctggtgattccagatttccacttgtttctccccgttcttctcaggagggaaaatcgtaatcgtcggtttaatttttccgccgttcgtggcgatttcaatatgttcaaataatgcgtcacgcacctcttctttcgtgttcacattgcgccggtcaatgacgttcagcgattgccagaacagacgcccgatacagcggttgctgttgcgccacgccattttcgccccgtgttcaagctcttccgccgtatggacgtaacttcccgtccgatctatctcatcttttatcgcgtgcagtcgcgcgttgatttgcgattccattccgagttcgtgatagcagacatcaataaaatccttcgcctcatcccaaagtatttccgtatgtttcaaaaaactctctccttcaatttacatctgtttcccattgtatcgtttttaggtgtgaacacaatggtttttttgtatcatactggaaactgcgaagaaaaaacacctgtgattttcgcaggtgttttacaaaacggaatgcagtttttcagccagtgtaagcaaatcctcacggtagttttttcccgtcatcggaattccgtgacccgtcaaaagcgcttccggctccagttccgccaatttctgaacggatgcggccgccgtctgcgtatccgctgtaaaataggcgggcggaccgtgaagctcttgcttttgaatgacaacgtccgcaagcgattcctgttcaacagtgatcacggcatcaccggcaagcagcacgcggtctttatcccggaataatgaaatatggccgggtgtgtgaccgggcgtatgcacccatttccattcttcaagaaacggaacggtaccgtctgaaggcagtgcctgaacggacggaatgcggatcgtatggcgcggaaacagcggtgacagctttgcgacaagcccttttttcgcatcgggcctggcaggcggataatccgctttccccgtgacgtacggaagctccttttcatgaatgtaaaccggcacattccaaagctcaagcagttcttcaatcgcaccgacatgatcaaaatgaccgtgtgtcaaaatgaccgccttcagctcatacccctctttgaaccggcgtttcatttcatttgtaatcatctccgacgattgaggcattcccgcgtcaaccagaatgatttcccgcggagctgagggattttcgataaagtaaacattcgcaatctgcacggtcagtccgtaaacgccgtccgccgctttaaaaccggcgccgcttctcactgaaaaaagcggcataaacggatcactcatcatggcacctcctctgatgcctttagtgtgcgacgaaccgggtgttttatgttaaaaaatcgtgattgcgccgatgatgagcgcaaaggccgtcatgacgataacggcaagaaccgcccatttcatcgcaaatttctgatgttcatcaatggtgaccccggcaagcccgactaataaatgcgtcgacggcacgagcgggcttaacatatgaatcggctggccgataatcgaagcgcgggcgatttccaccttatctacaccgtacgccacggcagtctcagataaaatgggcagcacgccgtaaaaataggcgtcattaggcatcagaaacgtaaagataccgctcgttaaggcaacaatcgccggaataaaacctcccatctgttccggaataagcgatacgagggaaatggccatttcatcaaccatcttcgtccccgttaaaattccggtaaacacgcctgcggcaaaaatcatcgaaccgatcgcaagcacattgctcgaatgggctgaaatgcgctccctttgatcattaagtttcggatagttgacaatcagcgcgatacaaaacgcaatgatgaacagcacggttaaattcacttttcctgacactaaaaatcccactaaagaaagcgttaacagtaaattgaaccaccacagtttcggccgcttccattcatcttccgcagccgcagccgtttcatttgtatgggacggctgctttaattcgatcaccccgagccgtttcctttccatccttccgagtacataagcgaccacaatcatacacaccattccgctcgcgatgacaggcagcatcggccccgtcagctctgccggatcaacgccgagcgcactcgccgcacgcggcgccgcgccgccccatggaatcgtgttcatgatacccatgccgaccccggcgattcccgctaaaataatcggacggattccgagcatgatatacaaaggcagcattgcgcttgtcgtaatcatatacgtcgtcgagccgtctccgtccagtgcgacaagcatggtcaaaacggctgttccgactacaattttgagcgggtcgcctttaaccagctttaaaatacgcgacaccatcggatcaaataaaccggtatcaatcataatgccgaaataaagaatcgcaaacataatcatcactgcgatcggcgccacctgttcaataccggagatcatcatctcgccgacccggttaaaagaaaacccggcaatcagcgcaaacacgatcggcgttaatacgagcgccgttaacactgaaagccgttttgtcataatcagcaccataaaaacaagcatcataagaaagcctaagattgctaacacagtatgtcccctcatcatgaatacgcttacattttaaaggcccgatcccctttatccgcctttttgctatcttatgagaattggatattgaagtaaatattttggattttaaagatttttaattttttataaccttttcgttcattttgttcatttataaatcaaaagccttccgcaaatatgcggaaggcttatttttcgctgctcatcatctctttataaaactcggtctgctcttctaaaaagcgttttgcgccgctgctgtttttataaaagctctcccaatcccgttttttcaacatttgcttccactccgcggatgaagtaatctgtttcaaagcctgatcccaataggcgatctcgccttcggtcatgtctttcggccccatgatgcctctccagtgcgcaaagacaaacggcaccccctgctctttccatgtcggcacatcgctgaagccggagagccttttgtcagacgtaacggccgccaatgtgattttccctttccgataggcgtctctcgcttctgaaatggtcattgaggcggcgtctatctcgtgactgataagagcttcaatgacttcattgctgcttccgtattgaaaaaagcggatatcaaacggagaaattccggccatttccgccgctctcgcaaaggagagctggtcatcatttccgaggccgggcgcaaatccgatttttatgccgcccggatttgctttaatatcgccgagcagccgctttccgctttttatctttgaatccttcggaagagcgacggtctgccactcttttgcgataatggccaaaggcgtaaaatcagctgccttcagccggctttgtcccaaaatttcattgcttaacagcagacttgaattcatactgatgacatccgtttttcgttcgtttacatatttccagccgctgtctccgcctcctccgggtttatagatgatctttacgggccggcctaatatttgcttccgctctattaccgattgcaaagcttttgccgttacgtcccagcccccttgaggcgctgccgggacgactatttcaaccggcccttcagctgaacggatgcccgccgcctgccgtccgtcaaaagaaaccagcgccgccagcatgacaagaagcactcccaaccgcttcatttctcccatcccttactcatgtgctaaataatatttccgttccggcctgccgataatgccgtactctaattcagcgagcgcttcttcccgagaaacgagaaactcggcgtagcgccgcgccgttgttctggaggcacccattttttctcccagttcttcagccgtcatccctttttgggccgttctgagcgcgtttttgattttttgaagcgtaatcgaattaatcccggtcggcagatcattgtgctgtttttgttctttctgaccgcttccgaaaaacatgtcaatcacggactggctcagctccggctgtgagtgcagccattctcttttttcacggtactgcaaaagcacttctgtaaatttatgtgccgacaccggttttatgacataatgggcaacgcctgatctgagcgcttcctgcagcagccttgtttcggcagaagccgtaataatgatgatatcaacggaaggaaaacggccgcggataagcgggagcagatctgttcccagctcatccggcatataaatatccaatagcagcagatcaggctgccgtttctcaagcagcgatatggtgtctttggcattgattgctttgccgatgacattgaatccatcaagatgttcgataaatttttcgtgaatttgcgctattcgaaagtcgtcctctgcaatcgcgatgttaatcacaccgattccccctttggcctttctttcggtataaacaccgtaaatacggcaccgccgctcttttgctgcgaaatctcaatcgctccctgcaactcactgacggcttctttcagattggctaagccgtatcctctccttgtcccctttgaagagtagcccttttcaaatatcgtttctgttttttcctgaggcacgccgtctcctgaatccgccacttcgatgacgatatccctgccgatatcggtcataaaaaaggatacctcttttttctctttttcggcgacggcttcgaaagcgttatcaataagatttccgatgatcgtaatgagctgggatgaacccacatgctccggcagcgattctaaaaagctgttttcatctattgaaagcttcactttcttctcagacgcctttcccatttttcctaatagtatggcctgaacccgctgtgaatgaatgttttgaaagaggatttcgtgctgttcattctggatggcgtactcttcttttatcagttcaatggcttcattatattctcccagctctaacagaccgagtatcgcgtaaagcttattcgagaattcatgcgtttgcgcccggagatcctccgagtattttttcatttcagtcagcttgttaatcagtttcttgagctccgttttttcgcggaagctgatcaccgctccgtatacttgtccgttctgcttcatttctttcacgtttaagataaatactttatctccggcacgcacctccacgttcggcggtaattctccccctgccaacaccggcatgagctttgcgcccggcatgatttcttttatatgccttccgatcatcggttccggaagattcagcatatcagccgcagataaattcatcatggttaccgcgccttctttgtttacggcgataatcccttctttcatcgcaaggagcatcgcattgcgttccctgtacagcgctgcaatttcatgcggttcaaggccgagtgtatctttacggatgctttttgcgagcgccgccgctcccccgatgccgataagaaacaccaaacatgcaaaatagcctaaatgccgcaaatgcgccttcatatctttttctatctcatcttgtagaaattcgactgtcaccgttccgacgacttcgttatgatttttttcctccaaaataaccggggcgcttccccggacggccttcattccgtcggaaaccggagacccgccgaacatgacggttttattttgcagattttgattttctttcggaatactgcttcgggccgaatgaaatgcaacatgccctttttgatcagtgatgtagacggcgtgcgcgcctgcctgttctttcatttgttcaatgacgtctaactttgtaaaagcctcttgatccgcaagccggaacgcctcttttacgggaggcatatatgaaatggtttttgccgtttgcaccgccagctgttcagcctgcttctgcccttcctttaattgctgaaaggcaaatataaccgtgagcgttccgatgacaagtattaataaagccgtaattaatccggcgattttcatttgcagagagacataaaaccgcttcgcttccaacacagcaccagccgtcctttcctcctaaaatcataccattttttaaatcttcatttctcatttttgagaattttcgcgatctttttctcttgtcatttctttcaaaaagtgcagtctggtataatttccctcaagagagataagaaggatgaactttttataatcgctgcgcaaaaaaagactgacaggagccagtctcgggatgtttcacaacggacgtatattcagttgacaaagtgtttctctatgatggctgagatacatttgaatgaccggaaatatcaatcaattttcctttgacggccaggcgtccttcggttcttaccgccttgtcgcatgtgattaatgtaatctctttatcttttgtctcctgaattgcgtttgcttctatttctgaaatcatggtttttgatgttacagaataaatatagtcttttctaaagtcggtaatcacgatttgcgcacctttttttatgtgtaaaagagggccgaacaataggttctcctgcttcagatggtggcctgccaacgggtagtttccctcgcccattttctgatccggacgcatagttgccgcgccgatcagcaggttttcattggttgtgccttttaaaatcggaaggtctaaatcgatgctgctgatggttatccgtccgattatcggtttcggtttgcgattaaaacttgactgaactgtttccctgaaaccgggcggatgaatggattcaaattcatagtccgcttttttcatgttatttttccgcgcttgttctgcggtcaattccgattcaatttggcttttactgaggtacgcaatcaaacagcctttcatgagaggagaggaaatgagaagcagcccggacaaaataagaacggcaatgatcatttttttaaccatgaagaaaattcctttcttgtacgtcatgcggtgagtatttggtgagaaatgattctctttttaaaaaagcacctgatcgattcttacatgatcaggtgcgattacgtctatctattccttgctttcttctttcttgatacaacagccgcggctccgccggctaatagcagcagaataccggccgtgaccggcatcataccgtccgtatcaccggttttcggcagatttttgcctgtatccgggtgattggttttactattggtatcagggtgatgcccgccttgattcgtttgatgattcggtgtgtctttcccaggtgcgggattttttaatttcttattagaaacgacgacctcaacagcttttgattgtcctttttcaattgtgaattcaattggtttttcgttcagctgatagccgtcaggcgcttttgtttcgataaatcgatactgcccgggcgctaatcctttcaccgtaaaccggcccttttgatccgtcttccataccgccggccgttctttgctgccgccggtgtttaccggatgtccggcagaatccgttatcttgaattcagcaccttccagcaccttatttttatcgtcatgatccacttttgtcagtgttacatcacccggcgtcagtgtattctccgcactgatttcgactggttttatgtcggtatttgtgatcttgaatgaaattggcgtttgatccaaactgtaaagttcaggcgcttttgtttcgataaattgatattcgcctgctttcagtccccgtacaacaatctgtccgtgctcatctgtcgtcagaccttctctcagcactttgccgtttgcatctgtcagattaaacttcgcaccttgcaggactttccgtttgtcaccttgatccaattttgtaagaacaacactgttcttgatgttaactgcagtcagggcagcctgatccggttttccgctgttctcagccttaatcgtaaaccgcacaggggttgttgacagcagataaccatccggcgcttttgtttcaacaaattgatagtttccgggcgccaaaccgccggcgtcaattttgccgccttcttttgtcatcagatcttctcttacggtttttccatcactgtcaatgattttaaatactgcaccgtctaaaacgtttccgtcttgatccttcttaaccagctggacagagcctttatagttgacaaaggtgccggtctcagacggcttcggctttccttccgctgtttctgagatggtaaactcttttttctccgtatttaacacataaccgtcaggcgctttcgtttcaatgaatgcgtaatgaccgggtgcaaggccggatgtttctacttttccgtctttatctgaaaccagatcgtcctgaaccgtttttccatcacggtcgacgattttgaagactgcaccttcaaggtttcggccttccgcatcttccttcgtcagccggacagagcctttatagttgacggccgttcctgcgtcagttgactccggctttccttccgctgtttctgagatggtaaactccactttcttcgtatttaacacatagccgtcaggcgctttcgtttcgatgaaggcgtaatgacccggggcaaggccggatgtttctacttttccgtccttatctgaaaccagatcgtcctgaactatttttccatcactatcgacgattttgaaaactgcaccttcaaggtttcggccttccgcatcttccttcgtcagcaacacagagcctttatagttgacggccgttcctgcgtcagttgactccggctttccttccgctgtttctgagatggtaaactccactttctccgtatttaacacatagccgtcaggcgctttcgtttcgatgaaggcgtaatgacccggggcaaggccggatgtttctacttttccgtccttatctgaaaccagatcgtcctgaactatttttccatcactatcgacgattttgaaaactgcgccttcaaggttcccgccgtctgcatctttcttcgttaaagcggcttttcctttataattcaccattgatcccaattcaacatcaggtacttgattcttttcgttctttgcgattgagaagtgaatggcttttgtgtttacgataaaccctgatggggctttcgtctccatcagccggtagtatccggcgggcaaaccgttgatctcaactttcccatttttatcgctttcaatattattttttatcagagtataggtaccgtcgcttgattttttctcaagcttaaatacagcaccggccaaaggattattgttttcgtcttttttgataagcgtcaccttatttttttgatttatgactttatagagtgctcctgctgcggaggatttgccgtcaatcgtaacggagaccccgtttacataagcatcgctgatggtgtagccgtccggcgcttttatttctttcagtacataggttccgtaacggatattcccaaacgtaagtttaccggcatcgtctgttgtgcccgtacgcagcagctgcttgccgtctttagaccataattgaaagtctgctcctgaaagagatgttccgtctgatcctgttttagatatcgtcaggcttcccttctcccctgaccctgagccgccgccgcttgaaatagcgacaaacactgagctgttgttctcttgggtctgctcctcaacattcgtccctgatatcgacactttgttgttgacctgaccgctgctgccggaaatattaatgagagaacgatattgtatgacatacgcacggtcgatttgtttatagccgcctgtaaaggtaagggcaaatgattgttcaccggtggcattgtcagttttcatatctaatttatagtccttatctttctcaagctgcacatcacccggaataagatttccgctgctgtctttcataacgccgttctcattatattttgcttgatatactttaaaagaatcttcatctattatttgattctcatccggtgtgtctttgacttttacgtcatccagtgtcgattggctggcattgacattgatgttccaatcgatattgtttccgttctgtttgccgcctttagaaatcaggtttcctccgtttgcgacggaaactgaacccgtcagcgttcggtctgcatggtcattattaaagtactctgctttgtttgtgtattgattctgtttaatgacctggccttttaatgacgttttaaattcaatcaggtatggtacagcgtcatctgttttgagatgtacggttaacgtatttttgttgccgtctgacggctcttctatttcatattttgaaggatccagcgcctctccttcagtgatggagccgtttttgctgatggtatacgttttaacagcaaccgacccatgcaaaaattgctgaccatctgtgatcgtatcttttatataaggatgttttgaaggttcgccattgtaattgatgccgactttccatgtgatttcttttgaaacggcgttgtatgagccgtttttgaatccgttatgggacgtctgattgttcggtgtgaagccgctcgattccttatttgtgcgtttgttgccgtttttatcggtccatgtcgactccgccgtatttttaatcgtttcgtttgaaaagtcagcgttgaattttgtcttatacgtgatcttaaactgactgtttgtttctgcgtagtccccgatcaatgctattgtaaagccttgatttccgggtttttttgttaatgtataatccgttccttctttcagcgttttgttttcagtcgtgtcttgcatgttaaatgaatcgtcaatgagcgccaggcctccgctggtgaattgatcatccagcgtccagtctttcattgtgtaaccgtttttgttaactgtgattgtccaatcaaccgtcttcttctcatagtctgcgtttgaataatgtttgatcagattctgctgaatggcggttcccggagtttcctttgagtcccccgtatctgtcattgctgtattggtgtatttgacaggactgtcaataatgaccccatcgttgacttgagattgataaatgatcttatatgctcctgtgacagtttgcttgaattttatttcaaagccgttcccgttatcagtcagcgtataatcatcaccctcttttaatggggcgccctcttgttcgctgccgttctggctgaatgtaatcggaaggactttcaatgatccgggaactagatgcagatcgtctgatccgaacgtatccttaatgccggctttggattgatcaatctttttctcaccgtagttgtacataacagcccagctgaacgtttgggtttctcctttataacctgtcgaagatttttctatcatttttccgtaacccgctgttacggaagcttccgcagaaatcggctccgcattgtctccgctgaatgccgccttgtttgtcagcgtgatgtttccgcctttacccggctttgcctcatctttaatttccgtgtcatatatgagccggtaggctgaatcaattgtcccggcgaaggtgacattaccgttttcgccaacggtataacctgaagttatctcatttccctgactcaccgagccgtcaatattcacatcaagttcatacactttcacagagcggaaagtcaattcgtccggaaggctttcagtcaatttcgcatttttaacttcttcttcctttttattaaggtcaaccgtccacgttacctttccgggattaatgcctttatccaatgaccctgatttctcaatggttttattgacattcggtttaaaataaaccgttacgtccggcgtatcagagttaaccggaaacttaatcttttgtgtggttgatccttttatttctttctgattgaattgggtgtttacatacaatgaccccttgacgttagaatcttcttttacctcgccgttaaacgtcatgatgacatggccgctcgtattaatggaaaaagttccgtacgtactatcgccgtcggtcaatggctggttcgtaatgtcattatgcataataaattctttaggcaggtcaaattcatatcgatcaccgtcgtttattgttttccccagctcattcggaatcgcccattggatggtgatattcgccggagagttcgtattcgcagggttgtttttgtcatatggttttcctttttcatccgtcaatttcacatcagttaaaatattttgcgtaatccggtttccgcctgattgaaggcttttagcggcagatttgcttgtaatcaccatttttgattgactgcgtttagcagaaggttttgatttcgttgcctgttctgctttatccccgccgtctgcagatgctgattttttctctgtcttatcctgaggttcagcaggtgttgaagaggtgtttttttctgtatcggaatccgttgttccgtctttcttcacaggtattaacacttgctgggtcttgccggcatccagttgaaaaagagcttttgccattttcgtctcatctgttatgtcgggagtaaacttcgccgacagtgtaatggagcctttggcatccccggcatccgcttcagcatcgttcactttcacttccagcgtgcttctgtttgcttcagctttatatataccgatcacccgatcagctgatttcagctcaccttcggcatcattatctaatgtaaaactttccggaatctttacggtgatattccggtcacttgcatcttctttgtgttttagtgaccattcgtatgtcagtgtcactttatctcccggtgttaaagccggttcaccggcttttgatccgtcaacggtctgctgtctgccgtctttgactgcaactgaatcaaagaacccgctctcgctatgttgtgatccggaagcggctgcgatcggagtaaagctgacaacttggctgaagatgaaaaacagcgtgaagcatgaaatcaatgccgccctcagccttttgctttttttcgggctgaacgaaaagttcctcactcccaatgtcttattcctccccttttatatagacttacgttcgaacaagccggtaagcatgggattctccttatccgaaccaaactacattgtatgaaatcggcctatacaaattctgtacatgggatcatttcagaaatagcgcacaaaaaaagaccggcatcagccggtccggtcattcaatcgtcaattgattttatcttttaattgtttatatcgttcgtattcctttatcgcctcttctacctttcccagtttattaaataactgcagtttgtattgtataattttatcgtcaccgggctctattttctcaacctgcaggcaaacgtccatcgcttgacgatcgttcttctcttggatgagaaaaccaatcagttcgtacgctttgctgagccacagatgggcaagacgcgctttttccggctctgcccacagatagccattctccatgagataatggttctcatatgacatgaccatgttcatgtgccgggttagtgcagctgcgctgagcggaggagcctctttgaatgttttttcccattcaactgtatcaatctttaccccggaaagccggagaatgtatcctatatcagtattttctattgattggctgaagggcagcttaccgattaatttccgtatctgatatattgtcgagtagagctgggtgcttgcttttgatatatcataagcaggccaaaacatctccattagcatgtctttactgaccgtgcgcccttgattaagaagtaaaaatgcatacagttcacgggctttggatgttctccacttgactgttatgtatgttttgacaccatttaccgattgataaaagtccaggttcccaaaacattgtataacataatccgtcccggtattcccgtccgccgacctgagttttttattcattcggatccgctcaacagttgtcagcagccgggcattgtcaaccggttttaatagataatcgacagcattcaattcaaacgctttgatcgcgaattcattataagcggtgataaaaataacttggatattttcattgacctcctgaatcgattcagcaagctcaataccgtttatcccgggcatttcaatgtcaagaaacaccgcatcagctgctgaaagttccgaatgctccagaacttccgccggatcttgaaacgttataatagattgaaaggcgtttgtccgctcaagcatacgattaaaatgaagcaatgccagttcctcatcatccacaattaacgctttcaaaccgcatcccacccgtcaatatagatatatctgaaaataatttcaattataccatgcccaatgccctatatagttggattctttttctttctcttgttgtattataacgtttgtgattacaatatttatacattaaataggataatagaatgcccctgaatgggataaaggagtaatgatgtgaaagaaaaatttatttcgattacgattatttgcggctatgctgctttctttatgatttttatggccatggatcatttttcaggatcatccctccctcaagcggaacagggcgtgatcaatctggaaaattgggattttcaaaaggatggaaatgtccagctgaacgggaaatggattctatatccaaatcagatgctgtcaccgcaggcgcttcattcagcaaaaggaaaaaatcccgtactcgttgatgtccctgtcaatgtgaagctgttcggaaaaacggccgacgtggattacggaacgtacaaactgacaatccgatcaaatgaagacaatcaggttttggggatcagcacatcttatatctacagttcaaaccgcctttatcttaatggaaaagtaatcggacagagcggcaatccttcagaaaaagctgattttaaggcgcagaacaaaccgtacagcagctttttcaggcttcgcaagggtgacaatgaacttgtcctgcatttttcgaatttcggaaaagttcccggctgggggatcgcaaaaccgataacgtttgggactcaagaacaaattatacgcgagaatcaaatttccttttttaatgattccattatgattacggcttttttcattaccggtttatattttctcggcttttttctgcaacggacaaaggataaacatttattgttcttttccgtgatgtgtctgcttttttcagccattattcttatgatcgggaaagaaagaattatctttctcctctttccgtctatttcattttcattgctgaattccttgcgtatcatctcaaccgtgcttgtcagcatggcggtttttctttatctcttttatgcatacagagaaattgtttcaaaaacgacgatcaccattttaaccgctttatccgggatcatcttgatcactgattttatgtccggaagtttcattgatcacctctcatacattttacattctgtgctggccgttacgactctgttttatattacatatatttttacgattgccgccataagaaaaataaaaggaagcacgtaccttacactcgcatccgtctcgatgagcgcttttgtgattcttacgaccatttcagcttacagcggcaaaacagctttttcttttaattcgatctattcattgccgacagtcatcgctttattggcggtggttctcctgatggcgcagcaattcgccggagctttccgggacaatgaagtcctctcacggaaattagtcaaaatggaccaactgaaagatgaatttatcgccaaaacttcacacgaattcaagacgccgctgaacagcattattaatatatgccaaacccttgtagccggcagaaaaaagaagacgatagaggaagagaaagaaaatatgcagctgatcatccgtatgggctacagactttccgatctcgtaaatgatattcttgatttggaaaaaatgaagcaggggatgctgcagattcgtccggttcccgtcgatgtgcatgccgtcatatgcagtgagatgaacttctaccggcttttatccaaacataaaaaactcgcgattcttaatcatgtgccggacgatctccctttggtgcttgcagatgaaaaccgattccggcaaatcttaaccaatcttattgaaaatgcaatcaagtacacatccgaggggaacattattctttccgccgcaaacctgaatgacaaaatgattcaaataaccgtgaccgattccggcagcggcattcctgaggctgatcttgaaaccatttttgattcttttcagcaagcgggagggaaggaagaagatggaacgggtttaggtttaagtattgtgaaacagctcgtcaagctccaaaacggggacatctgggcggagtcagcggcggcgcaaggatcagcctttcattttacgttacccgccgctcaaattgtttctttaccggaagcaaagaccgaacttcctaaatcacagcccggacagagaataccggatatttcgttggtcacgccttatcactcagagaaaatcgatgctccgacgattctgattgtcgacgataatatcgagagtttgaaaattttaattgatatgctggaaggtgttccttataacgtaatcgcagtaaaaagcggaaaagaggcgcttcaagctgtctcttcctcgaagcttgacttggtcatattagacttgatgatgcctgacatgacgggttttgaagtctgcacaaacatccgcgaaaggttcagcatggtcgatctgccggttcttatcgttacggcagccattatcagccatgacaaatacaaggcgtttcatgccggagcaaacgacattttacaaaagccttatcattactctgaattcaccgcgcgtattaaaaatttaattttaatgaagcatacggctcaccaagccacaaatttagaaatggcatttcttcagtcgcagattaagcctcattttctttacaatgtattaaatacgattatcgcgctcagccatttggatattgaaaaagcaagggaaaccactgctgcatttacaaactatttaaggatgagttttgattttcaaaacacttcggacatcagctcattcagaaacgaactttctatcattacgtcatatctttctatagaaaaaacacgcttcggcaaacggcttgatatcctttttgatattgaacaggacattgacttcccccttccgcctttaatgatacagccattggtggaaaacgccgttcatcacgggatcagtaagaaaagaggcggcggacggataaagctgacagcgaaaaaacaaggcgaaaacacgtatcttatcaaagtggaggataatggaaccggcatcatgccggacatacagaaagatattttgtcttctgatgttaatcgcagtgtcggcctgaaaaatatcaatcggcggctgaagcatttttgcggaagcgaattgacgatcaccagcaccccggatgagggcaccgctgtttcgatgatgattcacactcccggcacaacggatgattcgaactcactgaaaacgtcttcattaagatactgattaacttcaaaaggcatgtaaatacttctgccgactgtcgggaaattcccgtcagcctttacagaaagacgtaaaaacaaaaaagcttgaagaaaaaatgatatcttctccaagcttagcttagatgatccgcaccagtctggccgttctcacttaagaaatcgtaacccccgcgcttgcatatcccgccactgtattaataagcgaaaggcctgtcgcagtggcagagaataccattaacagccgggtttgaggagttaccgcaatgttcagccctgtcgtgattccgttgctgatgctgccgattgacaatacgccggtgaggggaggagctaaagtgacggatgctccggggatcggcgtgaacgtattgttcggcacagtagaactgtatagttgtgcggttatcgtaacagtcgagccgacaagcgacaatgctgcggttgtactgaaataggcggcaattgatgtaatggttccgcttctcggagcagaaaaagcaaagttcagcagagttcctccagccccggtaagatcaattgcacctccccctccgacattgacgcccgtcacagaattgccgaacccgacaaggctcaccgttccgattaatccgccggcaatggtcgtcacggcagtgggaagacctgaagcgtaaggaatgatcgcgcctgctccggtgatcccggtggcgcctgttgctccagtagcgcctgttactccggttactccggtgatcccggtggcgcctgttgctccagtagccccggttgctccggttgctcccgttactccggtcgatccggttaccccagttactccagtcgctccggtgatcccagttactccagtcgctccggtgatcccagttgcacctgttattcctgtcgctcctgttactccggtagcgcctgttaccccggtagctcccgttattcctgtcgctcctgttactcccgttactcccgttactcctgttactcctgttactcccgttactccggtcgatccggttaccccagttactccagtcgctccggtgatcccagtggctcctgtagcgccagtatccccggttactccggttgcgcctgttactccggtcactccggttaccccagttactccagtagccccggttgcccccgttactccagtcgctccggttgcccccgttactccagtcgctccggttaccccggtggctcccgttactcctgtcgctcctgttatcccagtggctccagttatcccagtggctccagtagccccggtggctcctgttactccggttaccccagttactccggtagctccggtgatcccagtggctcccgttactccaatcgctccggttacgcctgttaccccggtggctcctgttattcctgtcgctcccgttactccggtcgtgcccgttatcccggtagctccagtatccccggttactccagtggctcccgttactccaatcgctccggttacgcctgttaccccggtggctcctgttattcctgtcgctcccgttactcctgtcgctccggttaccccggtagcgcctgttatcccggtggctcccgttactcccgtggcgccgggatctccagtgactccagtggcaccggttaccccagtcgctccggtattcccggtcgagcccgttgctccggtcagtcctgttgctccagtgaaccccgttgctccagtcagccctgttgctccagtgaaccccgttgctccagtcagccctgttgctccagtgaaccccgttgctccagtcagccctgttgctccggtcagtcctgttgctccggtcagtcctgttgctccggtcagtcctgttgctccggtgcaccccgttgctccggtgaatcctcttacgtgaaaatgatttggatgacagcatggacaccatctttcatgacagcaagggggttcgcaacagaatccttcacagcaatgtgcccgattttgataactgcgcctttgatttcttcttttatgttgaaaatgacagcaacactcattacaatttcggcagtcgtaatcccaagaatcgtatctgttataccaagtatctccttttctcattacaccacctctattttcataatatttccacagagaaaaaaggtgtggcaaaaccccacttctattgggcaatttttcaaatgttcgttaagactgcatcatgcacagcattttacagaaaaaagacctaactgtgcataagtcaggtctttcatctttaaaatatcagtctgctgttgtattaggttgtcggaaaacttatgctgttaaaatcgatattgagtgcagttgctgtcgttaaattattagcagttgtgaaaataaccctgagctggtaagtgttcgttcctgcggtcggcgcagtatccactgttgtatcagcaatcgaaaaactatccgtagctgcgagagtactggttcgcgacagagttcttgtatgaatttgcactgctcccctatataatctcacttcaaaaacaaagtttgaattcgctgcagttgttaacgcggcactgagtgcataatccagctttacattctgcaaagcattaactgggattgccagcgtagcaacgggaacttctgtatttaacggcggataaacagtgagcggcccgttggttcttgtgaagagcaaggttggtgtactgcctgtggcgccggttggtccggttgggcccgttactccagttgggccagtcaccccggttactccggttgatcccgttactcctgttactcccgttgctcctgttactccggttgctcccgttactcccgttactccggttgctcctgttactcccgttactccggttgctcctgttactcccgttgctccagttgctccagttgctcctgtcacacccgttgctccagtcacacccgttggaccggttgggcctgttactccggttgcacccgttactcctgttactccagttactcctgttactccagttgctccagtggctcctgttgctccagtcacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagttacacccgttgctccagtcacacccgttggaccggttgggcctgttactcccgttgctccagttagtcctgttacacctgttggacccgtttctccggttgaacctgttactcctgttgcgccagtcgctccggttatccccgttgccccagtcactccagtggctcctgttgatcccgttactcctgtggctcctgttggacccgtgattcctgttgggccagtttctccagtggcccctgttactcctgttggacccgtttctccggttgaacctgttactcctgttgcgccagtcgctccggttatccccgttgccccagtcactccagtggctcctgttgatcccgttactcctgtggctccagtcacacccgttgctccagtcacacccgttgaaccggtttctccggttgagccagtaacccctgttgatccagtcacaccggttacaccagttgagcccgttgctccggtttctcctgttggtccagtcacaccggttgggcccgtcgcgcctgttgctccggttatccccgttgctccagtcactcctgttgcaccggtttctcccgttgtcccagttaccccggttggaccggtcgctccagttacccccgttgccccagttgctccggttgggccagttgctccggttgggccagtcgctccggtttctcctgtcgcccctgttactcctgtcgcccctgttactccggttgagcctgttgatccggttacaccagttaccccagtcgatcctgttgctcctgtggctccagtcacacccgttgaaccggtttctcctgttggtccagtcacaccggttgggcccgtcgcgcctgttgctcctgttatccccgttgctccagtcactccagttgcaccggtttctcccgttgtcccagttactccggttgatcccgtggttccggtttctcctgttacacctgttgggcctgttactcccgtcgctcctgtttcaccagttgggccggttgagccagttacaccggttattcctgttgaccctgttacaccggtcgctccggtttctcctattgaaccagttgatccggttgctccagttactcccgttgaaccagttgatccggttggaccggtcgctccagttacccccgttgccccagttgctcctgtcactcccgttgaaccagttgctcctgtcactcccgttgaaccagttgctcctgtcactcccgttgaaccagttgagcctgttgctccggttacaccagttaccccagtcgatcctgttgctccggtttctccagttattcccgttgcgccggtcgccccggatgcacccgttgcgccagttgagccggtttctcccgttgctccagtcacacccgttggaccggttgcgccagtcgatccagttgcaccggtttctcctgttgagccagtcgcgccagttggacccgttactccggttgcgccggttgagccagtcgcgccagttggacccgttactccggttgcgccggttgagccagttgagccagttgagccagttgagccagttgcaccggttgagccagttggtccgatttctccagttacccccgttgcccctgttgcgccggtttctcctgtcgctcctgttactccagttgagcccgtggttccggttgctcctgttgatcctgttaaacctgttggccctgttgcgccggttgggcctgtcgatcctgtggcgcctgtttctccagttaatcccgtcgcaccagttgagccggttactcccgttaccccagtcgctcctgtcgatcccgttacaccagttagacccgttactccggtggggccggttgctcccgttaccccagtcgctcctgtcgatcccgttacaccagttagacccgttactccggtggggccggttgctcccgttaccccagtcgctcctgtcgatcccgttacaccagttagacccgttactccggtggctcctgttgctccagtcactccggttggtcccgttgctcctgttaaaccagttgaacctgttcccccggttgcgcctgtttctccagttattcccgtcgcaccagttgagccggttgagccggctgctcctgtcggtccggttgggcccgttcccccggttacacccgttaccccagtcgctccggttatccccgttgtcccagtcactcctgttggacccgttacacccgttaggcctgttgtacctgttactccagttgacccggttgctcctgttgatcccgttactccggttgcacctgttgctccggttgggccagttgatccggttgctccggtttctccagttattcccgttgcaccggttgagccggtttctcccgttgagccagtcggtccggttattcctgttgacccagttacaccggtcgctccagttactccagttgagcccgtggctccggtttctcctgttgagccagtaacccctgttggtccagtcacaccggttgggctcgtcgcacctgttgctcctgttatccccgttgctccagtcactccagttgcaccggtttctcccgttgtcccagttactccggtttctcctgttacacctgttgggccggttggaccggttggaccggtcgatccggttattccagttgaaccagttactcccgtggctccggttggtcccgtttctcccgttgcaccggttactcctgttgtcccagttaccccagtcgctcctgtcgatcccgttgcaccggttgaacctgttactcctgttgatccggttactcccgtcaccccggttgttcctgttgaaccagtttctccggttgaacccgttgctccgattggaccggtctctccagttacccccgttgcccctgttgggccggttactccagtagctccggtatccccggtcgagccagtttccccggttgctccagttactccagttgcaccggtttctcccgttggacctgttactccggttgagccggttatccccgtcgcaccggtggctcctgttgctccagtcactccggttggtcccgttgctcctgttaaaccagttgaacctgttcccccggttgcgcctgtttctccagttattcccgtcgcaccagttgagccggttgagccggctgctcctgtcggtccggttgggcccgttcccccagttacacccgttgcccctgttgcgccggttgggccgcttggtccggttgggccggtcgatcccgttacccctgttactccggtcgctcctgttactcccgttacaccggttgggccggttgagccagttactcctgttgggccagtttctcccgttgcaccggttgatcctgttactcccgttacacccgtttcaccagttgggcctgttacccccgttgctccggttgggccggttgttcccgttcccccggttataccagttaccccagtcgctcccgttgcaccggtttctccggttgagcctggcgatccagttggaccgatctctcccgtgggtccagttgatcctgctgcaccagtaactccagttgaacctgtcgacccggttggaccggttggaccggttgatcccgttgctcctgttactcccgttgctcctgttgaaccagttgaacctgttcccccggttgcgccggtttctcctgtcggtccggttgggcccgttccccagttacacccgttgcccctgttactccggtcgctcctgttactcccgttacaccggttgggccggttgagccagttactcctgttgggccagtttctcccgttgcaccggttgatcctgttactcctgttgatccggttactcccgtcgccccggtttctccggttgaaccagttgggcctgttacaccagtcgctccggtttctcctgttgcaccagttactccagtagctccagttactccagtagctccagtatccccggtcgagccagttgggccggtttctcctgtcgaccctgttcccccggttggacctgtcgaccctgttcccccggttggacctgtcgaccctgttcccccggttggacctgtcgaccctgttcccccggttggacctgttattccggttgggccggttgggccggttgatcccgttgctcctgttactccagttgagcctgatgagccagtcgcgcctgtttctcctgttactcccgttgcaccggttgcaccggtttctcccgttgagcccgtcggtccggttgaacccgttgcccctgttattccggttgaacctgtagatccagttggaccggtctctccagttgcgccgatttctccagttacacccattgcccctgttgggccggttgggccggttgagcctgtagatcccgttacccctgttactccggtcgctcccgttacacccgttgcccctgttgggccggttactccagtagctcccgttgcaccggtttctccggttgagcctggcgatcccgttggaccgatctctcccgtgggtccagttgatcctgctgcaccagtaactccagttgaacctgtcgaccctgttggcccggttggaccggttgatcccgttgctcctgttgaaccagttgaacctgttcccccggttgcgccggtttctccagttaatcccgtcgcaccagttgagccggttgatcctgtcggtccggttggtcccgttaccccggtcgatccggttatccccgttgtcccagttactcctgttggacccgttacacccgttaggcctgttgtacctgttactccagttgacccggttgctcctgttgatcccgttactccggttgggccggttgctcctgttgagccagtcgcgcctgttgatccggttgaacctgtcactcccgttgaaccagttgagcctgttgatccggttacaccagttaacccagtcgatcctgttgctccggtttctcccgttgtcccagttactccagttgggcccgtttctcccgttgatcctgttactccagttgatcccgttgcgccagtcgatccggttactcccgtcgctccagtttctcctgttgaaccagttacaccagttgcaccggtttctcctgttgaaccagttacaccagttgagccggtttctccggttgagcctgttgcaccagtcactcctgttgggccagtttctccggttgcgccagtaactcctattggaccggttgagccggttggaccggttgagccagtcgcgcctgtttcccccgttggacctgttactccggttgagccggttatccccgtcgccccggttgctcctgtcgatcccgtgaccccgatcgggccagtcacaccagtttctccggttgaacctgttggtcccgttcccccagttacacccgttgcccctgttgggccggttgggccggttgggcctgtcgatcccgttacccctgttactccggtcgctcctgttactcccgttacaccggttgagccagttactcctgttgaaccagtttctcccgttgcaccggttgatcctgttaccccagtcgagcctgtcgatcccgttgcaccggttaatcctgttactcctgttgatccggttactcccgtcgccccggtttctccggtttcaccagttgggccggttgttcccgttatgccagtcgagcctgttgctcctgttactccagttggaccggttgttcctgttgggcctgttgctccagttactcccgttgaaccagttgctccggttggaccggtttctcctgtcgcccctgttactccggttgggccggtttctcctgtcgatccagttggacctgttataccggtcgcgccggttatccccgttgctccggatgggcctgttgctcctgttatccccgttgctccagttgggccggttgttcccgttcccccagttacacccgttaccccagtcgctccggttgaaccggttgaaccagttgctcccgttactccagtcactccggttgagcccgtggttccggtcgctcctgttacaccagtcgagccggttgctccagttactcctgtcggaccagttactccgtttggaccggttacacccgtcgctcctcttgccccggttgcaccagttactcccgtcgctcctcttgcgccggtcactcctgttgggcccgtcactccagtgggacctgtaattcctgttacgccaggttcacccccggtttgcgccaatgaaacatcgtctattaaaaccgtgccggaagaaactttacttaatacaatgacggcagaggccgcgccagaaggcacactgcttgttttatagatttcagaccatgtgtgaaagagcacgttcggcaaatttccgggtgtaatattttcttgaatggaactgatttgttcacctgctgcgctgacatagatgatctggagagtgacttggggacttggatcatttccgagcgttgcgagtgatacgaatagagtcactgacttggctgaaatgggaacgatttgactgaggtaagcatatggctgagctccaataaattgcgcagaatatctccctgaatgtgcaaacaaactgttaatctgggtatttgccgaactccaccccgctaatgtgccggtttcaaagcttccgtttataatcggattattcattcaatctttttccctctccttcccgttgttgaccgtcttacttattaagacagcatattaatacgggctgtgttttgacaacctaaataaaaaaggtgatttcttttcatcaccttaatccgatccttgaatggggaatcccgtcgcaatgagggagcggtttgctgctgcgacttgtgttacgtagttcgaagaaaggacggataaatagagctgatacgcggctgtttcatccgccttcatttcgtcgatgtacgtaaaaggaattcctatgatttgtccgcctgaagaaaagaggttccgctcttgtctctgtgtttgtatcgttacgccatttctttgcagctcgacagctaagaccaatgagaaatgagacgcaagcggatctaattccacatttacttgtatgacggcatccgttttcaccaattgatctgtcggcgcagctatcactgcgcttaacacgtttatcggtgttccttctaacggaagcgtcattaggtctgctgtattttgaaaagctaccgcaggaaccgctcccggcggcccctcaggccccgggggaccgggcggaccgggcggacccggcggacccgcctccccttgcggaccgcgggagccggcgggtcctcttttgccttcgggacctcgcagcccgggtacgcacaaggcagatcgattttcatttgaagacggaaaccgtttttccgtccctgtttccggactttcaagttcacatggtaattgttcataccggcgtttcatatgtctgctcatatatttgtaaggtttctgtttcaatatcatgtattgattacggccgctgctcataatatcaccccggcaatattctattcgcactgaagtcagcgtgtgcaggcccttcccattccttacagaaataaaaaaaaggcagacctgagtctgccttttttcttctaccataaccctaatactttccaccataatccgccgatcacaagccatgtcacaatatggacgattgacaggataaagccgatggaccaccatttgctttgcgagatataacccgctccgaaaaagaccggagccgctcctgagccgtaatgcgtcgtcgaaccgaaaaggttgctgaaaaacgccaggctgagcgccgccaacagcggcggagcgcctgccgccacgatgacggcgagaaatgccgcatacatggcgctgatatgcgcggttgcgctcgcaaagaagtaatgcgtgtaataatacacgacaatcagaatcataaatgccacaatccatgaaaaaccggaaacagatgatttcatcatattgctgaaccaagacaccatgccgagctcattcaggaaattcgccagcatcacaagcgccgcgaaccaagtcagcgtatcccatgcaccttgttcttttttgatgtcctcccatgttaatacctgtgacaaaagcaaaacggataatccgatcagggccgtcgtcgttgcgtcgatatttaagcttcctccgaaaatccacagcgcaagcaccaataaaaagacgataaccatggagagttcggattttttaaacggacccatttctttcaatttttccgttgcgattttagccgcgtccggtgtttctttaatttccggcggatacagcttataaatgacgagcggcgtaatgattaagctcgccaatcccggtacaatggccgcgattgcccagcttgtccatgtgatgtccacccctgcgacatcgtgggccagcttggcgatcagcggattcgccgccattgccgtcaaaaacatcgcagacgtaatcaagtttccttgaaaaccggtttttaataagaaagcgccgattttccgctctgttccgtctgccggcgttgatccgaaagtttcggataatgatctgataataggaaaaataatgccgcccgcccgtgccgtgttgctcggaatggcaggtgataaaattaaatcactgaacagcagtgaataagaaaggccgagtgttttcttcccgaaccgttgtacgaatacgtaagaaatcctggcgccaagcccggttttgataaatccccgggaaataaaaaaggcgatgacaatcagccagattgtcttgtttccaaatccgcttaacgtattttcaatagatagcgttcccgttaacgcggtgactgccaatgcaaaaattgcaattgcgcccattggcaagggcttggagataaagccgataattgttgcgacaaaaatagcgaacaaatgccatgctttaggttcaagtccggacggcgcgggaataaaccaaatgattaatcccacagcaacagtaataagcaaaggaatgatttttactgcctgctgtttttttgcgtctttttctgaagccattacaggtctcctcctattttgttgtcttccatccccctatcccattttactacttaactaagttaataaacgtttttgttaattaaaaaacacaaaggaatattttcctttgtgcttcttgtttattattttaatatacccgacccggctttagatataacatctgattttacatttgatgatgagccgatggaaccgtgcaatgacggtgtccagccgacggactgacttaatccgttggcagctgacgcgttaattgcggcgccgtttaaaagagtgccgtcttcatgaagtgcttttccgccgctgaagacgctgatgactttatcagcagccagtcccggcacttcaaagacattattctgggcatatatttttgacgcgtggcctgcgccccacgcatagctgaacgggtatgcggcgcttttagagcctgcgtaaaaattattataaatatgaacctgcccgtaccggacccgcggtgcgcgctggacgatgttctggtaatagttatggtgaatggtcaccttcagttttccttcatccgacgtcttgctgtcgctgtttccgatgacggagcctttgtcatggtcatgatatttattataggacaatgtaatataattcgccccgttggctatatccgtctggccgtcatggtgctgatattttctcccgtaatagtagggaaaaccgctgtcgggattcgatccgtcattaaaggtgcaatgatcgatccagatatgcgtcgcgccgttaatggtgatattgtcatattccgagttccagttgccgctgctgccgtccgtcgggtcccattgcggaaaatagtcgtaagcgtcttgaaattcaatgttgcggatgatgacattgtcgacgccgttctttatattaaaacttccgcctgtcactttggcatttgaacccgaaccgatgatcgtcgtatttgaaggaatgtcaatcacgacccgtgctttctggtttttttgagatcgctgtctggcgtcttcctgggtgcctgacggcgcttttttcccccatttgtccgggtcgtacgccttcagataagcgttgagatcatatgccggatctttataatcattaaagccgagcgttttattccggtcgtccgtattcatattgattgtgccttgtatgtaaataatcttcggcgtgctgttggcgcttccccctaatgcagaaacgagctgctgtctgtttgatacggtgtagacattcgataaagaggctttcgcgccgccggttgtcccgccggaagcggctccccagccgtcatttgttcctaacgtctgccgtcccaggtcagcggcatagacgtccgcagggatcatacataaacaaaccgccagcataagtaacatttttttcatgaattgtgctcctcctgattctctgttccaatttattacaattggattgtatcaaatcagttgagaaacggcaccgaaaatgtacagcatgtgcctttcggttttattgcggaaaccgcaaaaaaatcccaagggaccgaaaaccccttgggatctgttcagcttacgcccatgattttactttttcgttatccgtgacaaacagaagaacttttccttcatctaagcgcttttcaaattgtgatgcttcctcttctgaaaagccgatttcgtgaattttgttgcggagctcgtcgccttttttattaaacatattgccgaccgcgtgtttaatgcccgtttctttcgctccgatggtattgacatcagtattatccgccagacggtccgttctgtcgtcatcatgtgaaagcacatatacgtcttcttttgcgacacccaattgctgaagctcttttacgtcctgcatcagtttttgatcatttgtatattctcttactaccggtttcattgataagtcctcccttttgtttttgtatattggatgtttacccgctcaaccaaaggtcaaacaaaagaaagagagttccgggaaaaaacgggcagattgtcggtggatattttccggcgggacatgttacagtagggaaagtaacttttatcagaaaaataaaaatcttcatgagccgattaagcagggaggtggttcctattcattacttttcaccggaacagcgatttaacgcttgggttgtcagtgatttagtgaagcaggtattccgccggcatacccgctgcccggatggaataaaagagcttacggcctttgctgaagatacttttcatattaatatcgatttcgttttctctatcattatcaatatcggtgatatcgaatccgttctgccgacagaaattgaaaataagctgggttcttatctgaccgcgcttcagcccgtgattacctctgacatgcttcattcttcaaaaacgaatgcctatgaatatttggaacatgagaaaaacaccgatgtgtaccggttattcttttaaatacgcatataagaaaagaagggccctggcccttctttttttgttgccggcggacggtttgattttgtattcgggaaatggttcgtgttacatttggaacaaccacttatcttgaaggaggattcagtatgccgaataatcagcagcagattcaattggcaagacgcccgaaaggcgttcccgtccatgacgatttccgctttgaaacgattgccgttcccgaaccgaaagacggcgaagtgcttgtgaaaacgagttatgtgtccgttgatccgtacatgcgcggacggatgcaggatacaaaatcatatgtagagccgttcgctttagatgaagccataacaggcggagtgattgccgaagttctgacagacggcgataagctgaaaaaaggagatgttgtgatcggaaatctcgcatggcaggaatattcagccgtcaatgagtccgccctccgcaagttggatacggatatcgcacccgcccaggcgtatctcggcattttagggatgaccggactgaccgcttacttcggcctgcttgatatcgggcgtccgaaaaaaggcgaaaccgtcgtcgtttcaggggctgcaggcgccgtcggctcaacggtcgggcagattgccaaaatcaaaggcgcgcgggttgtcggcatcgccggttctgacgaaaaaatcgcgtatcttaaagaggagcttcaatttgatgaagccattaattacaaaacggcggatgatattcaaaaagcgcttgaacaggcatgccctgacggcgtcgatgtctattttgacaatgtcggcggaccgatttcagatgcggtgataaacctgctgaatgaattcgcccgcattccggtatgcggagcgatctcttcatataataccgaaagtgaagaggaagacatgggcccccgcgtccagccgaagctgatcaaaacaaaagcgctgatgcaggggttcatcgtcagtgattatgctgaccgcttttccgaaggcgcgaaacaattggccgaatggctcaaggacgggaagcttcattatgaagaaacgattacggaaggattcagccatattcctgacgcgttcctcggtttgtttaaaggagaaaacaaaggcaaacagatcatcaaagtcagtgatctaggttaacatgatgatgaaaaaaggagggctttgtcccctccttttctgctttttcgcatcagccgcgaagaatcaaagtaagaaagccgtcttcatcaggctccgtattttccaaagtgaatcccgctgcttgaaagcagactaaactgatttgattgtctttttagatgcttgccgcccattcccgcacgccggtaaacccaggatcagtcagcagtttttgcaagatctgttttccgtacccttgaagctggtacaaaggattgacgatcaatccgatatacgcccgttcctccacaaactctatagagaccattcctgccggaagctgcccgtcatatgccataatgacagtatcgtcttcatctttactcaatcgtgcataccatgcatttagtggccgcatcgcatccattctccgtctgatattatcgttcttaaaccagtgttcaagtattttcagctcacgtaccttcaatatttgaaatcggtctattgaaaccatcttcccgcccccgcctgaaccttttctattatttcacaataaaaaagaagggcttcccgccctccgtttcttatttctcagataattttccgcctgaataaacggcctctttcagctcaattccgagtgatttggccatttttttcaatttggattcttccatcggcgtgacaaggctgagtacggttccttctttaccggcccgccccgtccggccggatctgtggatatatccgtcttcattcgggatgtctgcgtgaatgacgtacggaagatcatcgatatcaagtccgcgcgccgctatgtcagtcgccagaagcagcggaaattctcccccttcaaacgctgataatatctttgcccgctccatttttttcgcttctccgtgcaggatgccgagatccacgtgatgataggcgagtttttccgcatagacgcttaaatttccgatatctctgacaaacacgagcgcctgcatgccgttcagccgtgacagcttttgcaatagcttcactttatcccgctgatcgcagacgagatattgatgcgtgacgcgcgctttttccgccgtattccgcgccactttcaaaacggccggttcatgtgcgatggcattcagcacctcttctgtctccggctgcagcgtagcggaaaagcttaaaagctgtcggtctttcagcgtcgttttaatgatttttttcatcgtttcgcggtgttcctttgtcacgagctgatccgcttcatcaagaacgatcgtcttgacttcatgcattttcagctttttcgcctgaatcaattcgagcaccctgcccggtgtgcctgcaatgatatgcggtttatttttgagcttctccacctgctttttcacgtttgccccgccgatcaaagacaaagcgcgaagatcggagccttttttccactcctgaatcacttgaaaaatctgcatcacaagctcgcgggacggcgctaaaatgatcacttgcggatgtttctgttccgggttgatccgctccagaaccggaagcgtgtacgccaatgtttttcccgttcccgtcggggattcggcaatgacgtctttcccttccatgatcacctgagcggctttttcctgaataacggtcggctcctgaaagcctgacgcctcccagttttcggcgataaatggttgtgtatgctgtaaaaatggccatgtttgggtcatgtcgttctcctcaattcttaaaatctactccatagtatctcaaatgcacgcggcaaacgcaattttctttttccttccaagccttttaacaaacggtctcctcctttataatcataaatgagaaagacacatgataaaaaaagcgtgtctgataacgatagaggtgtaatgatgagtattttatccgtaaaagatttaagccacggcttcggtgaccgtgcgctttttaacaatgtatcgttccgtcttttaaaaggggaacacgtcggcttaatcggagcaaacggcgaaggtaaatcaacgtttatgaatattattaccggaaagcttgagcctgatgagggtaaggttgaatgggcgaaaaacgtgcgtgtcggctatctcgatcagcataccgtgcttgaaaaaggaaaaacgatccgcgacgtgctgaaggatgcgttccattacttatttgcgatggaagaagaaatgaacgagatttacaacaaaatgggcgaagcggaccctgatgagcttgagcagctgcttgaagatgtcggtgtcattcaggacgccctgacaaacaatgatttctacgtgattgacagcaaagttgaagaaatcgcccgcggcctcggcctgcaggaagtcggcctagaccgcgacgtcactgacttaagcggcggacagcggacgaaagtgctgctcgccaaactgcttttggaaaagccggaaattcttctgttggacgaaccgacgaactaccttgatgaacagcatattgaatggctgaaacgctatttgcaggaatatgaaaatgcgttcatcttaatttctcacgacattccgtttttaaacagcgtaatcaatttgatttatcatgtggaaaaccaagagctgacgcgttatgtcggtgattatcatcagtttatggaagtctacgaagtgaaaaaacagcagctcgaagccgcctacaaaaaacagcagcaggaagtggctgagctgaaagatttcgtcgcccgcaacaaagcccgcgtcagcacgagaaatatggcgatgtcccgtcagaaaaagcttgataagatggatatgatcgaactggcggccgaaaaaccgaaaccggaattccatttcaagcctgcgagaacgtcaggcaagctcatttttgaaacgaaggacttagtcatcggttacgatactccgctgtcacgcccgctcaatctcagaatggagcgcggacagaaagtcgccctgtacggcgcaaacggcatcgggaaaacgacgctgttaaaaagcctgctcggtgaaatccagccgctggaaggcacggtggagcgcggcgagcatcaatacacgggctatttcgagcaggaagtgaaagaaaccaataacaatacgtgcatcgaagaagtgtggagcgaatttccttcctttacccaatacgaaatccgcgccgccctcgccaaatgcggcctgacgaccaaacacattgaaagccgcgtctccgttctcagcggaggagaaaaagcgaaggtcagactgtgcaagctgatcaattcagaaacaaacctgctcgtgcttgacgaaccgacaaaccacctggatgtcgatgcgaaagaagagctgaaacgcgcgctgaaagaatacaaaggctccattctgctgatttcccacgaacccgagttctacatggatatcgcgacggaaacatggaattgtgaatcttggacgacgaaagtgctgtaaacacaaaaaggaactcccgcccgtgcggaagttcctttttttaatgtccggcttttattccggcaagatgtttgcgtcccataagaagaacaagcatgccgacaaaaacgacaatcccgcctactgtatatggtgtgcttgcggtgaagtgttctgacagcattcccgcaatccacggagcgagcgcaccgccgataaagcggactgagctgtaggctgaagacgcgatggaacgttcaaccggcgcagcacccatcacagcggttgtcatgatcgtattcaccataccgaggacagcaccggcaacaacgatacatgtaatgatcaacgtctgatggtcagtccagacccccataataacgagaatggccgcaaaggcgataaagagaacgacgagcgaacgcactgtgcccagcgctttatgcacgagcggcgccgtaaagactgacgtaattgccagcagaaggccccagccgaagaagacgtatccgagaccgtgttcatctaaatccagaacgaacggagaataagcaagcaaaataaaaaatccaaagttgtataagaatgcagatactgccattgtcaaaaggcctttatatttgagcgccttcatcgcatcaaacacaccgacgcgtttcgccggtttcggcagcttcggcagcatgagtgaaatcgcgcaaagcgctataaacatcaggacagacactccgaagaacggagcgcgccatgaaaggctgcctagctctccgccggcaagcggcccgacagaaattcccagtccgagcgcggcctcatacagaataatagctttggcgctgccgccgacagatacaccgacgatgacggcaagcgcggttgaaataaagagagcattcccaagtccccagccgccgcgatagccgacaagctgagcgattgaacttgagcttccgccgagagcggcaaacacgatgataaaaataagtccgagaagcagcgtccattttgcgccgatccggcttgaaatcgcgccggagaaaaacatcataaaaccggtaacgagcaaataacttgtaaataacagagatacttcactaggtgaagcatgtaattgtgcggcgattgccggaagaattggatcgacaagaccgattcccataaaggaaatcacacaggcaaacgcaaccgcccaaacggctttcggctggctgaataagcctgttttctgttgtgatgatgtatccatttgaccagacctcctgttttatccattaaaagaaacgctatatccatagcgtttacagcaaaatcattcgattgattgaatggcgcggtcagctttttctttcattccgttaaggcgcgttttaaaatgctgaaatgtgctgatcttctcatcaatcatctcaagctggtggttcaaagcgtgctgaatctcttccagcttttctttccgttccttcggatccagtgacaacaagtacccctctttgtttaattccagctgacggctcatctccataaactgctgaagttcctgaagggaaaaaccgagcacttcttttgtgctggtgactttttcgagctcctccatatcatcttcagagtaaagccggacgccgccttctgtccgtttaggagcaggaatcaaaccaatctcctcgtaaaaacgaatggttcgttttgtcaatccgcttcgcttggcaacttgatcaatcttcatccattccaaggtgaatccccctcttgtcgtatctgtttctattatacaccatttgaaccttaacgtaaacgtaaactttttatgccggataaacttggcttggacggaacctttgtctttaaagcgccgggagacatctgtgtaagataaaaaaagccggtatgacccgccatcttctcggggccgtaccggcttttcttaattctcaagttcttcaatcatcagtgacaattcggtccagcgttccatcgccgcttcaagctcttcagccgtttttgcctgttcggccatcagttcttgtatctttccgaaatcacttcccgcttcagcgatttccgcttccagacgctgatgcttttcttcaaggccggcgattttgtcttcgatgccgtcccattcgatctgatccttgtacgaaagctttttgcgctttttcttcggctcttcttccgcctttttctcttcggccggctgttttaccgccgtcttcttctcttttgcttgttccatgtattcactgtatgaaccttggaaacgggaaatgacaccgtgtccttcaaatacgatcaggcggtccacgacgcggtcaaggaaatagcggtcatgggatacggtgatgacgacgcccgggaactgttcgatataatcctcgagcacgcttaatgtttctgtgtccagatcattggtcggttcatctaaaaacagcacattcggctcctgcatcagtacattcagcaagtacagacggcgtttttccccgcctgacagctttctgatatatgtctgctgcatcggacgcgggaacagaaaacgctcaagcatttgttccgcggtgatgacatcgccttccgccgttttgacgatttcggccgtctcttttatatattcaatgactttcatatcgccgttcatttcgctgtgatcctgggtgtagtagccgatccggaccgtctgcccgatggtgatattgccgctgtcaggctgaattctgccggcgaggctgtttaaaagtgtcgttttcccgattccgttcggcccgatgatgccgattcgttccccagggatgacaagctcattaaactggctgatcagcgcttggccgttataggtaatggagacgttatcggcttcgattacttgttttccgagacggtgggaaccgatcgcgaaatcgagtgatccggagactgccggccctttttgctccttgagcgcctccgctctgtccactctcgctttttgtttcgtcgagcgcgctttcgctcctcttctgagccacgccaattcgcggcgcaggaggttttggcgttttgtttctttctgctctgccagcgcctcccgttcggcccgtttttccaggaatacttcatagtttcctttatacgtataaaggctgcctctctcaagctcgtaaattctgttcgtcaccctgttcagaaaatatctgtcgtgcgtgacaagcataacggcgcccggatattgcgataagtagccttccagccattcaatcgtttcattgtccaagtggtttgtcggttcatccaaaatgagcaggtcagccggctggatgacgtttttcgcaatcgcgacgcgctttctctggccgccggacagctcgctgacatccttcatcagatcggtgacgccaagtttggttaaaaccgttttggctaacgtattcgcctcccacgcatcattcgcgtccattcgggcctgcgcatcaagcaggtgtttctgacgctggtcattttccggttcttcattcagcgcctgaagcgctttttcgtactctctcatcgttctcatgacggctgatccgccggaataaatatgttcaagaacggtttgtccggccggaagctcagggtcctgatgcaagaactcaatatgcacgtttcctgaagccgtaatctcgccttcctccgttgattcaaggccggcaatggttttcagaagcgtagacttccccgttccgttcgggccgattaaaccgattctttcattctcttcaatatgaaaggagatatggtcgaataatgtcttatctccgtatgttttataaaggttttccgcttttatgatgctcatggttcctatcaatcctcacgtaagttcatgtgttcattttaaatcaggcgctgtaataaaactagtaaaaggacagacaaatttcttggaagagatcattttgtccgaagaatgtttccgcctctccttttatacactggaggggaagaggtgatgacatgatcagcgtcagtttgtgcgttatcgtgaaaaatgaagaggaagtgcttgcgggctgtcttgattccgtcaaagacattgcggatgaaattgtgattgctgatacgggctcgaccgaccggacgaaagaaatcgcggcccgttatacggataagatttatgattttgaatggatcgatcactttgccgccgcccgtaattttgtgttttcgaaagcggaaatggattatattctgtggctggacgccgacgatatgctgacggtaaaggaccgtgaaaagctgattgaactgaaggcgtcgctttcaaaagaggtggacgcggtatccatgtattatcacgtcggctttgatgatcggggagaggtcagcttcagataccgccgcaaccgactcgtcaagcgtgaaaaagggttccgctggatcggagccgtgcatgagtatcttgaggtatacggaaacatcatagaaaccgatattgccgtcacacaccggaaatccgaaaaaaagcactcgcctccctcggaccgcaacttgaagatttatgagagaatggcggaaaacagtgaatcgatgacaccgcgcgatttgttttacttcgcgaatgaattaaaggatcacggccagtatcagcgcgccatcacgtattatcaccattttctttccacaaaacagtgctggatcgaagacgagatcagaacgtgccaatatctatccgattgctacagggcggtcggccatgaagaggccgccatgacgtctctcttaaaatcatttctgatcgattgtccgcggccggagttctgctgcaggctcggcgactattttgcggagaaacggcaataccggcagggcgtgttttggtatgagctcgccctatccgccaaaagcagtgatgcaggctttacccagctcgaatattccacctggtacccccatctgcagctctgcgtctgccactggcagctcggcgacagagaaaaagcgaagattcataacgacaaagccgcctcctatcatccgtcacatccgagtgtcctgtataatcaaaacgtgctcggcacataacatcaaaaaaaagagctgccccgtatgaagggcagctcctttttgattacgctgtcggaattcctccgcttacactgtaaatttgggatgtcacatagcttgattcttctgaggccaaaaagacataaattcctgccagctccgccggctgtccggcacgctttaatggaacggccggtgtttccttgccgaatttcggaatgttttctccgggctgtcctcccgaaatctgcagcggtgtccagatcggccccggcgctaccgagttgactctgattcctttattcgccagctgctttcctaggccgacggtaaaaccgataatggcatgtttcgtcgcagcataatccaacagcatcgggcttggattataaccttctacggacgttgtcgtgataatagacgcgccttccggcagatacggaagcgcggctttgacgagccaatacagcgagaatacgttgacttcaaatgtttgatagatttgttctgtagtaagatcgctgatatcatccactgcctgctgtttgccggcgacaagagcgagcgtgtcaagaccgccaagctcttgatacgctttttccgccaattctccgcaaaacgcttcatcgcttaaatctcccggcagcagaacagcttttcttccctctttttcaattaacgctttcacttcttcggcatccggctgttcctcaggcagatagttaatggccacatccgccccttcccgggcataagcaatcgcggcggcccggccgatacctgaatcgccgccggtgacgagggcttttcttcccttcagcttgccggctcctttatagcttgtttcaccgcagtccggcacaggcttcatctctttctgcaaaccgggcggttcttgatattgttttggaaattcatcatgatcatatttcgtcagcgggttgtgcagatttgcatcagacatacaagactctcctttatcattggtgatgtattcgtatgtgtacccctgagcatgacggatcaaacgtgtaagtgcagtttccgattgataagggaaaacaaaaaaggagcccgtaagctcccttttttatgattctccgagcacgttttcagccattttcgctaaatgctgggcgcttcccgaaatctcctgcatcgtggcagaaatttgttctaccgccgccgcttgaccgtccgtgttctggttgatggattcaattgagtcctccagccctttcagcaggctgtgaatttttttcgtaatctggtcaatttggccgacattgtcttttgaatgagtggcaagcttgcggatctcatccgccaccacggaaaagcccttgccggattctcctgctctcgcggcttcaatggccgcattcaaaccgagcagattgctttgatccgagatgcccttgacagtaacggaaatgtcggcgatttctcccgcgctttcactgacttgtttcgcctgagcggaaatcccggtcatctgtgctgagaaaccgctgatggattctgagatatccgcgatcgccgaagcggtctgttccacgacggcggacaggctttcagcgacatcatgaagcttggctgatttttcaaggctcgtgccgagaccgacgccgccgatgacttttccgttttcatcgtgaagcggaatcgctctggcgatcagcggaaatccgaacagctctttcggcaccatgcttgtcttcttctgattcatgcggatcgcgtctgtaatgatgtcccctttttgcagcggatctcccggctttacattaagagaaaacgttttagccggaatattcacgattaatttttctgtatcataaattccgatggtgatgtcatcttggatcaggctgtttaaaaaaggcgcaactttgacaaaagcgtcaagcaggctgtgcgtttgctgctccgtctgtatactcatttctttcactccttcttaatatgggaattggcgtttttcatgctgaaccgaaatccatttcagcgtggtgaattcttcaaggctccattcgccgttcagcctgccgagacctgattgtttctcgccgccgaacgcaacgttcggttcatcattaatggtcgtatcgttgacgtgaatcatgccggtttcgatccgcttagcaaactcaacgccccgctccacgtttgccgtatgcacggctccgcttaaaccgaacggtgtcgcgtttgcgatgcttaccgcttcatcctccgtttcaaacggcatgatgcagacggccggtccgaacagctcctccttcgcgatgctcatctcaggtttcacatcttttaaaatgacaggctcagcgaccgttccgctgaatcggccggacagcaccggaaccgctccctcttctatcgctttttcgacagaccgtctcaggccttccgcctgtctctcattgattaaaggaccgataaccgtatcagggtccatcggatcgccgactttcagcgatgacactttcgcttcgtagagctctgtaaatttgtcataaacagatgtgtgaacgagcacgcggttcgccgacatacagatctggccttgatgcgtaaaccggctgaatacggccgcattgacggcgtattcaagatcagcatcctcaagcacgatcagcgcgctgtttccgccaagctccaacagcggttttttaaagtgtttgaccgcaagctgtccgatatagctgcccactccggttgagcctgtaaatgagattatccgcggcacgggatgctcaacaaagctgtcgccgatctccccgatatccgtcacgatgacattcagcagcccgtccggtacgccggccgcttcaaaaattttcgcgataagcgttccgccgcagatcggcgtttcttcatgaggcttcagcacgacgccgttccccgcgccgagtgccggcgcaacagatttcatcgaaaggaaaaacgggaaattaaacgggctgatcacccctgcgactccggcaggtattctgtacagcctgttttcttttccgtcaatcgtggacgggagaattttcccttccatccgcaccggaaatgttgcggcttcttttatcatatttttgacaagtccgatttcaaactcagccttcagccgtgttccgccaagctcctccatgattaagtaaataatcgcttcttcgtgctcttcaatgaaagaaacggctttttccaaaatggcccgctttttaaaagggtttactttgtcccattcttgtttcgcaagagccgcggcgcgatatgccgcatccacgtcatcaggcgtcgcttttcggaatgaggtgatgactttttgagtataaggatttctgttttccaatacgttccggctgctcccatccctccatcggccgccgataaactgcttatttagttcttcatattgaaacatgtaaacatctccctttcaccgaaacttgaaattagttgatgagtcatcttttgtatcggtcttaaggtgagaaaattgaactatttcacaataaaattccctttccttccgtgcatcgacgctttttagctttgtccttttaaagtggaaaattctttaattgactgcgagaaatttcgacaatataatacaaacgtcagtgtatataatgataagaatattatgaattttcaggaggacccatatgtctttactatttcggaaaaagccgctggccgacttaaaggcccagagcaaacagaccagcctgtcccgctcgttaagcgcttttgacttggttttgctcggaatcggctgtgttgtcggcacggggatttttgtgattaccgggactgtggccgcgacaggcgcaggaccggctttgattctgtcgtttgtgctcgcgggccttgcctgcgcgctcgccgcgttttgttatgcggaattttcttcatccattccgatttcaggcagcgtatatacgtattcatatgttactctcggggagtgtctcgcgtttttaatcggatgggacttaatgcttgaatatgttatcgcgctcgccgccgtcgcaaccggctggtcatcctatttccagtcgcttcttgcaggattcgggctgcatcttccggaggcgctgaccgccgcacccggcagcaaaacgggtgccgtgttcaacctgccggccgttatcattattttggtcattaccgcgattgtttcaaggggcgtgaaagaaagcacccgctttaacaatgtcattgtattgatgaaaattgcgatcattctgctgtttatcgtcgtcggtttcggctacgtgaaaccggaaaactggtcgccgtttatgccgttcggaatgaaaggcgtcatcacgagcgccgcgaccgttttcttcgcgtatctcggatttgatgccgtgtcaaacgcgtcggaagaagtgaaaaacccgcagaaatcaatgcctgtcggaatcatcggcgcgcttgccatctgcaccgttctttacattacggtatcgctcgtcctgacaggaatgctttcgtacaccaagctgaatgtcggagatccggtatctttcgcgctccaatttgtcggccagaacaaaatagcaggcattatttccgtcggcgcgattatcgggattacaacggtcatgctcgctctgctttacgctcaggtgcgcctaacatttgcgatgagcagagacggccttttgccccgcatgttttccaaggttcacccgcgttttaaaacaccgtttcaaaacacatgggtgacggggatcgctgccgccgggatcgcaggttttattgatctgggaaccttggcgcatctcgtcaatatgggaaccttggcggcctttacagtcattgcgatcgccgtcatcgttttaagaaagaaacatccggagatcaaatcttccttccgtgttcctttcgtgccttttgtgccgatcatcagcgcatgcttatgcctgtatctcgcaagcagcctgccgggcgtgacatggctcgcctttgtcatctggatcgccgccgggatcgtggtatatatgatgtattcgagaaaacacagtttgttaaataaataaaaagggaggctcttttttctgtttgagaaagaagagccttttttgcccttgataattcattcaccttatgaataatatggtgtatgcttcgtttacataaaaaggaggagaatcactttggcaattgccgccccgcttaaagaaaaacctgtccatcgtcccgagacaaccatgtattctattttgttcattatcgggatctgtcatctgctgaacgattcactgcaagcggtgattccggcgatgtttccgattttggaacgttccatgaatcttacatttacgcagctcggaattatcgcctttacgctgaatatggtgtcttccgtgatgcagcccgtcatcggctggtatacggataaacgcccgatgccgtatgctttgccgctcggactcaccgcaagcatgctcggcattttaggtctcgcgttcgccccgtcttttctgacgattttatgctgtgtcttttttatcggccttggctccgccgtctttcatcctgaaggatcgcgtgtcgcttacatggccgccggcgaaaagcgcggattggcgcaatcgatttaccaagtcggagggaataccggccaggcgatggcgcccttgattaccgcgctgattctcgttccgctcggtcaattcggctctgtctggtttacgctagtcgccgcaatcgctgtgctgtttctcatttatatcgccaaatggtataaaggccgccttattcatttgcgcgccgcaagtaaaaaatcaccggccgccgctgtgcagaccgtgattacaaaaccgattattcttgcacttatcatgattatcttcttaattttcgcgcgctcctggtatgtgagcgcgatcggcaacttctatacgttctatgcgatgaatgcctatcatgtcagcattcagcaggcacagagctacatcttcgtctttttatttttcggagctgtcggaacgtttctcggcgggccgcttgcagaccgtttcggaaagcggaacgtcatcatcgtttccatgacggcatcggctcccttgacgattttccttccgtttgcgggacctgtcatcgcctatggcgtactggcgctgatcggcgttgttctgatgtccagcttctccgtgacggttgtctacgcgcaggagcttgttcccggcaaaatcggaacgatgtcagggcttacggtcgggctcgccttcggaatgggcgcgatcggagcggttgcgctcggagctcttattgattcagcgggattgacgccgaccatgacagccgtcgcctttctgcccgttttaggtctgctcgcctttgtcctgccgagcgacaaaacattaaaagaatggcattcataaaaaaatccctgccgaaaaggcagggattttatgtttcaaccgtataaaaatgagtgtcaggaaccgcatatttcggaataaacccgtctctgaaatcaggaaacgctttttgaatttcatcaatccatttttttacgtttttgatgtacgggacgtaaatcatactgactgtcgcctcatcatcaatgtgatagtaccagcagagattgaattcgttctccgtgacgagcgtaaagcctgaaaaatgataaaaaatcagcggggtgtcattgacatatacagccccgtcgcgcaggctgacgtcatattgctcaatattccacagcgccgcattcgcgccgatcgactccgtgacatgcacgtgttcaaactgcgcgggccacttttcaacatacctttggtcaccgtatgtctttttttcttcattcatctccaccgtacaataggagatgcaatcctgtctccactgccagaccgcccgatacgcttccccggtattccgcgcgccgacaaacccggtgttgtactgccccgtcagcttgtaataagacgcaaaccgttctgaattgcggtgatccgtcagaaaaagggaagcatccggcttttccgcaaacagctcgcccgcatctgagaagaaaaagagatcggtgtccaaatgggcaaaatattcggcttcatcatactccgtcatcacatggaacagaaaagccggcttcagcgtccagcaatattcatgaaacgtccggccgccctttgcttcaagcagctccgggtcctccatttcatggagctgaaccgctgtgacatgttcccacggcacctgctgaagcagttcgtacgctttctgatcgacacacagcacatacagatgaaaatcccggcaatgctcatggagagaatgaatcatcggcatcagtttaaagatatgcgttctggaaacaatggttgaaaaatgatatttactcaccatatcacatccaatttatttaagatccacatgcagtaaatcagcagtcagcgctttgaacgcccttgcaaagtgcgtgacgcccagctttttttccgcttttgccaaaagctttccgacctccggcagctggaagctgttcgccgtgatccgcgggcttttcgtcttccagtccggatcgaggttgcggtctttaaccgcgtgcagcagttcgagaaaaatgtgcagcaggctttcatatttctcataatcaagcagcacttcgatgtctgccattatgctgttggttaactccgcgtcaaacgggccgttaaacgcgaggtgcacgtcaagcgaatgaatgtcattgtacttgtcgcacatgtacgcgatattcgccctgatgtcatcaacggaagcgcagttgctcggatgctcctgatggacgctcatgatatcgcgccgcagctgaaatctcattcccgactgatgaagcctgatgccgagatcataatcttcaaagccgtatctgacaatgccttcatcaaacaggccgagatctgccacgtgctgcctcttaactgatgaattgttcgtaatgaaaaaacgccatggcagacggtagccgttcaaatcatctccgtatttttccaaaatgcttttcagcacccggataaagtcggtatctaaatcaaagcatcgttcaagaaagcttccgtctctgatgtcactttcatcaaggagcggctctttatcgcccggcagctcttcatacagttcggcgagtttttccttatgctctttttcaaaacggtcataataaaagctgtaaatccgcttccagaacataccgcatacgacaagatcgtcccggttctcatgagccttgatatgcttcgccaccaaatccttttcggcaagcatgtcgctgtcatggaaaatcaaaatatcgcctctggcattgcggaccgcctgattccggccgtaagcgatccctctgttttctttaattctcacaaaaatcagcggaaaattcgcgctgaatgattcaagcatggataaggttccgtcttccgaaccgttgtcagccacaatcacttcgaacggctctgtgcattcctgttcattcagggacagcaggctgttataaagcctctccttggaattatatgcgggaacaatgacgcttgccttcacttttcgttcacttcctgtatatgatcatttatttgttatcatcctcagatgcaaagccgctgaactcggggcagacggcgctgaccgtcccgatcacccgcttcagaatgtcctgataaagctgatggacaaacggcaggtcggtccggtccgtctcatgaatctgccgaatgtcgccggctgtgacgatccggtatccgctgaaatgatagaaaatcagcggatttccgtcttcgagcacaagacgcccgtccttccatgaaaacgtgtggcggccgtaattccaatggccgatattcacgccgggcgtggtgatgtcacacacgttcgggaacagaccggacatgtaatccaagtagccttgatctccgaattttccttcgcccggcgcatttttgcattcttcaaggcagcgttctttccaccatctgagacaatctgtgccggcactgtcggttttgaagctgagaaaaccggaattataccggcctaaaagacgctgcagcatgtcgatttcctgtttttcaaatgagggaatgacgatatcgccccgtgacagaagcaccgaacaatccggctgattgtcaaaaatcgcgcgcggatcagcgaagaaaaacaaatcggcatcaatgtacgtgacacgctctaattccggatgtccgtccagcacgaattcgagaaataccggcttcaccgtccagcagtattcgctctgatccctcgtccgcttcagttcaaggagctcctcattttccagtgcggacacctgaatcaaggtgacattatccggacgcattgcctgaagcacgtcataggtgtcttgatccatacacaaagtaaaaatgggggcgtccgcctgaaccgctttcaatgagccgaacaaagcgatagcctgatacagccttccttttgataaaactgtgcaatatgcgcttgtcacgtctttctctcacctctgtttctgttacttttgaaaaaaggctttataccattcgatcgttttttctaatccttcatcaatggtatgcgcgggcgtccaattcagaagcttcctcgccttttccgctgataaatattggtgcttgatttcgtggcttccctggttaagcactttcggcttgaggtcactgtccatcgccttaagaattttttctacaagttccagcaccgtcagctgaatctcattgctgaagttgaacgcttctcccgcaagattgagctcctccatcttttccgccagcaaaaggtatgcctcgaccgcatcctcgatgtaaaaataatcacggataaatgtgccgtcgctgcggatttccggcgcttcaccgttcagcacgagctgaatcgtctgcggaataatccggttgaagttcaaatctccgccgccgtacaagttgccgcagcgcgtaatacagaccggaagtccgtacgtattaaaatatgtgtggcttaataaatcggcacagctttttgatacgtcatacggatgtttgccctgaagaggcatgttttcatcgtacggcagtgtcggctggtcgccgtacgctttatcactggacgcgacgatcacccgcttgatgagcggatgcctgcggcacgcttcaaggatgttccatgtgccgagaatattggcttcaaatgtggaaatcggattgcggtttgcgacgccgacgattgcctgagcggctaaatgaaagaccgtgtcaatttcatactcgcccagcgcccgctcaatcacatccagatcttcaagcgcgccctgcacgatattcatttgcttcacttgttctccctgatacaggttcgacttgggcacagtgtcacggacaagtcccgtcacattagccccctgatcgatcagttccttcaccaagcagcttcctaaaagacctgtacatcccgtcacaaacacatttttatttttccagaaactcaaacttgatcaccataccttccatacatgttgtccccggtcccacatcttgttaatttccagcagatttttatacgtatcgatcgccgtccagaaaccgtaatgccggtataccgccaattcgccgtcctttgccagctccttcagcggttcttcttcaaacatgacgtccctgtctttcggcagataatcaaataccttcgggctgagcacgaaaaatccgccgttgatgatgccgtcacttgagtttttttcagaaaagcttttcgccataccgtcttcaaccgtcagcgttccgaattgcgaggtcttttctataccggtgacggttgccgcagccccttttgattgatgatagctgatcagatgaaacaggttgatgttcgccagtccgtccccgtacgtcataagaaaggtttcatcaccgatgatgtccttcgcctgtaaaagccgccccgctgtctgcgtgtgttcccccgtgtctaaaaaagtgattttccacggctcggatgttcccaatatccgcacttctccggtagagctgtccagcgtcatgctgtgattcttccagtcataatctaagaaatattccttaatcatctctcctttgaaaccaagaagcaggataaattcgttcacgccatagtattgatagagtttcataatatgccatagaatcggtttgccgcctatcatggcgagcggtttgggacgttcattggtgatttcgctcattctcgttccttttccgccgcagagaatgactgctttcatctctacccctcttctctgtgaatattggattcgaaaccgcccgtataagagaaaccaacccgataatttgtccgattctctaccaccggtttcaaaatctactgtaagatatgagagattggcgccctttgtgaccaaaagctctctcttttttcagattggtgaagatacacacaaaaaaagagcctcacggaaattccgtaaggctctttctattatttattatcctgattcagcttttctttgccgtaatgatatttagacggatcaaccggcgtaaagtcgctcaatttgtggaatctgagcaggtctttgtacatcacgctgtcagacagcttcagctgctctgtgactctggctttcaggtttttcgtttcctgattgcctttcagttctttccctgtcttcgtatcgtatacgacattggagatggaagtatatttcggcgtgacgtaatctccgttgcggaacgtcaccgtatcatcatggtctttcgagaagagatcggtgccgaaattaatatatttcttagaatcgatgccttccaagtgaaggatcgtcggcacaacgtccatttcaccgccgtacgtatggttcaccccgccttttttgccggggatgcgaagcataagcggcacacgctgattctgcgcgttttgataaggcgtaatttctttgccgagaatttctttcatcgcgcggttatggttttcagagattccgtaatggtctccgtaaagcataatcaccgagttgtcatataaaccggatgacttcagatctttaaagaactgttcaagcgcttcgtcaagataacgcgccgtctggaaatagtcatccacagtcgcgtcgcccgttttcgctttttcgatcgttgcgtctttttcatcaagcgtaaacggataatggttcgtcagcgtgagcaaatgcgcgtagaacggctgtttcagcgactgaagcttcggtatagattctttgaagaacggtttatccttcagtcccatattgacaaggttgtcatcagacatatcgtatgtgctggcgtcaaagaatttatcgtagccgatatgtttgtaaatctggtcacggttccagaatgatttgtagtcaccgtgtaaaacggcgcttgtatagccctcactttggtcaaggatggcaggaagcgattgatacgtgttttccccttttgtcacgaaggctgacccttcaggcagtccgaacagactgttatccatcatcagctcggcgtcagatgttttaccttggcccgtttggtggaaaaagttatcaaagtacgtcatgtcctctccgccgcgggcgagtttattcaggaacggcgtaacttctttcccgtcaagtttgtaattgatcaaaaatgattggaagctctccaggtgaatcttaatgatgttcttgcctttggccttgccgaaatactcggcgttcggcttcgcataatgcgacgatgtatagttttcaacgctcgtcaggtcatcactgctggcatatgcccgctgtgattccgtctgcgccgtctgtacgccgtcataaatcgtgtaattataaaggcctaagtattttacaatgtaattgcggtcaaacgttcttgtcagcagctccgggcggtcctcttcggcaatcgccaggttcacgaagaacaacacaatacccgtcacgataattaatgacgtataccgttttttcagcttgaattccttcagctcacgtctccacaccagaagcgcgattaaaataataatatcaacaaagtataaaatatcatggccggacataatgctgaagatgccgtctcccatatttccgacattaccggattgctttaagttcgggaatgtcaagaaatcatcgaagaatcgatagaataggatattggcatacaaaataaacgtcatgatgaaatcaataatcaccatgataatcgctgatttgcggcctttcgcaaacaatgccagtcctaaaaagaaaatggcgcttgagaacggattgatcacaagcagaaactgctgcgtcggacccttcaccccaaggttgaattcagcatgataggctaaatacgttttggcccaaaacaaaataatagccagtacaaaaaaactaagtctgtaagaaaataatttcttcatggcaacctctactttcctaaacactttaaatctgtattcttactttttgcttcaattcctgctttccgagcaaaacgaaagcatcacacagccccataaacacaccattttaaaaaacgatatatttatcattcgtgtcatgcctattgaacatcttatcccgccagccattagacgcaggatatccgttcttcgtttcacatttttttctggcattaaaaggtaccttatcagacccggtctgaaaataggagataccaaatataagaataacacaaacttctaaaaacgaaaaatgaatatcaaagacagccgcccaacaggcgggctgaagttattgtatgcaaagggactgaaaaacttgaaggttttttttgggtgatgtaaaaaaaggaccggagtcatccagtccttttcatcacatcgctcaaatccccgcccaaacatcttttgcgtaaatgccttttgtctggaggtccaaaagccattcttgcgcttgccgttcgtctgtttcgcggaccgactgatacgctttttgcagcgttgcctctacatcgggcgccattttgctgccgtctccgcatacgtagaggcgccctccccggccgaggatggaaattaaagcgccggcgtctttcgccattaagtgctgcacatacgttttcggtacgccttctttgcgggagaaagccgtatgaagcgtcacgattccgtctttttcataagcttcaagctcgtcacggtaaataaaatcatgatcgtttctgcatccgaaatacagatgagcctcccccagctcttttccttctttttttaacgctgcccgagcctgcagaaatccgcggaacggggcgactcctgtgccgggaccgaccataataatcggtttttccggatcttccggcagccggaatcgtgtttccggagtgcggacaaacatcacgataccatcctcagggcggcggtccgctaaataattcgaagcgactccgcgatactcacccaaaccgctccgggcggggccgcgaacgacgccgacggtaattgaggcctgcccgggatgtttccgaggcgaacttgaaatcgaataataccgcggcttcagcgggcgcaaaagctccagaaatcgctcaaacggaagttcacacgcttcatatttttcaaggagatcgagcatcgagacgcgcgatgttaagatttgctcctgatagacgccctcctcaagaaaatcttccaattcccgtttgtgcggcggacagaccgtataagcggccatttcccggatttgagcccttgatgccgcttcctgcaattcgacacagctgctcagaagatcatgcagcctgaccggccgatcgagcgggagatgagccgcgctctgtccgctggccgtcagcagcacttgatcattcccgttcagattgaaccggcggagaacacggctgacctgctttttgctgtttaccggcagcacgccgagatgatccccttcatgataggcagcctctttcggcagagtgatttcgatatgccttgtgctccggccgctttccggcgcctgaagttccctgttttccgcaacggatgcgtaaaccgcttcatacgtctgtgccaacggagacccgccaagcccgctgacaaattgaaggcccagcgcacttcgctctttttcggcattttcattcagcttaagaccgaatgccttcatggcgtccgtccacatgctttttttccattcatcaagctttccttcaaaatccccgctgacgtccccttcgcctcgggcagaaaagcgttccgccctttttcggcaagcttctcatcaatcagtctcggcacagcctgatatgtcgccgcccagttatgatcaccgcagccgaagacggcatatcggacaccttccagctccccgggtttgacttcttcaagccattgaacgaattgtcccgcgttgctcggaggctttccgttataagaggacgtaatgatcaagagagctccttctttcggcagttttccgatccggtcatttaaaggcgccgtttcagtccggacgccgtgcatcccggcagtatcggcaagttcccgcgccacgccttctgcggttcccgtatctgagccgtacaaaatcagaagcggtcggttatcaagcccgataatggatgcgccttttgtttcccgtttttctttttcgacgtcttccgccgctttttcagccgccgggagagctgccgcaacggctcctttgtttctcggccgcacccggatatgaaagtcgccgggcttaatcgtcagtgtctgtttaatatcgagctcataatcggtgtgatcgataaaggtaaaatgctgcagaatcatccccagaacaagagttgcttcatgcagggcgaactgcataccgatacacgccctctgcccgtttccgaaaggcttatacgcatggtgaggcactagatcaggatgttcaaaccgctccggataaaattcctccgcattgtctccccacgcgtctttatcacggtgaagctggggaattaagacggaaattctgtctttcggcgtgatcggatatttcccgccgatcaccgtatcctctttcgcataaaggctgaacgcaggcgcggtcggccataagcgcaatgactcctgcaaaatcattcggatataactaagctccagtacttgtttataagaaggaacgggatcggtcaaaacccgatcggcttcttcataggctttttccaaaacacggggatgtttcagcagaaaatagatggcaaaggaaagcaggccgctggtcgtttcgtggccggcaattaaaaacgtgatgatttgaaaccggatattttcatcatcaagtttttcgcccgtttccgggtcttccacattcagcattctggccagcagatccttttcatcccgtccgcctgaccggcgctctgcgataatactgtctactaacgaaaacatcgcctgaatgtcatgatgaaattggcgcttcgtcctgatcatgagcttatcctgaacatcaaggcgctgcatttggtgcatcgcttcatcaagggcgcgcaccatgctgttgataaacggatgaggcgtttccctgtaatagctgttaaaccgatagttaaagccgcaaagcccgatcgtatcgagcgtcaggcgggtcatatcagcaggcacatcaacggcctcatccgggttcagcctagcccatttttgaatcagctgcaccgcgatatcagtcatcatcgaatgataatctttcatcgcgcgctggctgaaggtcggcatcagaatattatgcgcctttcgccagttaggctcatgcgtccagcttgtaaacagcccgtcaccggcaaacgcccggactttctccaaagcaccttcaatgcttttatcgaaccgctcttcatcacatacctctttcaccagttcatgtccggacacgacgataatggcgcccgccggggtatgcagctgaaaaataggcccctgctcgtttgccagtttgatcagcgacattgtaggcttgtctttatcaagcaaaggaagattgccgagaggaccgaatgtcttcggctgcggaatcggacctgtttccttcatgaataacaccctttcttacacattgatgcgttccttccaactacagtgcccttttcaccggccaattatccgccgttacggatcaatccccggattgacgattgataacggttttttctatactggagaggcttgttaaatacagaaataaggtgagttcacatatggattttgaaatcaagtttttatcgttttatgtcattcaagtggaaggaaaagacgaacaggcaaacaaacagttcaaacatttccagacccttgacacagacgaatttgaagaaagcgagctgaaggattttcttgacggggaattgaagaaaatcgtcaaacggaaagctgaacggcatccgcaatccgagcaggtccccacaaaaatcggccattttatcacggagccgggccatgagcttgattcaaatccgaattacaaccttttcaaccgcgccagacttgcggatacgaaggaagcatttatcgaggcaagcgaacagttcgtccgtacttatcttgacacgagcgccgtgcgcggcggtgtttttatcgtggcttcggccgttccgcgcaaatattttgaggacaaattcgtctttatgatgaaatgcgatttcgagccgaaggtcgcccgcatctcagacgcctcgtctctcattaaaaaggtcgaaatggccatcacgacaaaaaacatgaaaagcattcaatatccgtatatgccggaagaaggcatgacggaagagcatgagctgaaaatccaccaggcctcgcacgcccgttatttcgaagattttctcaaatttgtcgaatatggcgaatcgatgccggaaatcatgaaaaaccaagtcatgaacatggtgcaggagcacgtgtatgaaacttttgaagaaaacagcgaagagcttcagcagtttgagcacgacattgaaatttgggaagcgagtgaaaagcgggaaattcaggagcgcctcgacacccatcaagtcatcgaggcatccgcgcagatcattgaacacacgccggaagccgagctgaaaatgaaagtcggagaaacagagattaaaggattactggctgatttcggcgaatccatccatctcgcaaaagtgaacgggcgctatgtcgcgctcattgaggcggagacgatctcgtttgaaaaaggcagttcgccggtggagtttcacaagcctgaggggctgcatgaggtgattgagcggatacggaataaatctgaacaagactgacaaaagtccagacgccatgttctggactttctgtatttaataaggctctttgagcaatcgatagcattcaccgatgatgtcttggacgccgggcgttccctttatctcgcggcggacgatttcagatgagagattctgcacctgtaatgcccgctccgcccgtctttcgaagtatgcttgacatgcagtttcatggttttcgtgtttttgcagttcttcactaagcacaatcgcgtcttcaatcgccatcgccgctccctgcgccaatgtcggcgctcctgcatggacggcatccccgcccagaacgacgcggcctctgtgccacggttctttgaccgccatctgctcaatcttatgaaacaaaacgggatattcctttgacatattctctgtcacaaacttcactcccggaattccgcgcagcaagtctctcacccgttcaaaacgcgtgtcctcgtcatccctgaagtcagcgtcatacggccggatgataaatacgtatcctgttttttcagagagcggcacgaccccgacctgcgtctgcccctttttatacatcagtgtcgaatcatgaaaaaccggctcgggaaaagaaatgtaaaatctgtgcgctcccatgccgagatactctgttttcacttccctttgcagcatgtgattgcggacagcggagcggatgccgtcaaagccggcgaggatgtcagccgtcatcgcggttccgtctccacaatgcaccgttatttcatctgccgtttcttcgtaagacacgacttttttaccgggcagaatcgtgacccccgccgcctcagcatgcttgctgaggatatcgtttaatgtttgccgcaatatattattccgccccggcaatgaatcatctaaaaacgcctcactcactttaaactgcagcgttccgttttcatcatgctgcttcagccaatccgtttgaaagccgtgttgacagcattcatcatacacaccgatttcccgaagcacccgaagcgcattttgaggctgaagaatgcccgctccgctttttcgcatgtcggacgccgcctcgcaaagggttacttcaaaacccgctctgccgagagaaatcgctgcggacaggccgccgatccctccgcccgctatgatgatctttttcacttcatggttcatcacgataccgccttctcaatttatttatcatttgttaactattagccaccttactatattggctgaaaaactgtcaatctttataggttgccttttgaatccggcaagcttatactttgaatcactaaaatggtacggaggcttacaaaatggaattgagacatttgccggattactcgcagattgccggacgcgctgagatttacgccgatatggatgctgaatcattgaaaacatttttgacgttatttgatatgtctaaaaaaatgaatcaggtcatggagcattatttctcaagtcacggattgtccgaagggaaattcaaaattttaatgtttctgtttgacgaacccggccacagcctgagtccgacggagctggcgaaaaaatccaatgtcaccaaagcgaccatcaccggattgatcgacggactcgcacgggacggctttgtaaaccgcagccggcataccggtgacagacgaaaaatcagcatcgaacttacaagggaaggaaaagaaaagctgatgctgtttcttcccggccacttctccaacatttcaggagtcatggaaagcttcaccgctggagaaaaagcggaattgacaaaaatgcttgaagttttatttgataagcttctgctgttttccggagacagaacataaagtagtattgtaaaaacaaaggcaaatttctatgagatagaaattgaagtaaaaagatgagggttataaaaaaacagcctgcacattagtttgttcaggctgtttcagaagaaataattttaaaattactttctcttcactataaatgcaggtgttttaatgctggaagttacatttgtatatcgatttttagtcttcaacctcactctcacactatttgatcctttttttaacgatttttgatttgagagtttaaatacttttttaggtgttgagtgactgaaagaacctttctttgtttcattagccacccattttgaaccgttccaaacatcaattgtcatggaataatcaaatgttgcgattgtcccgccccatatgatgctacacaatcaatagaagtagcttttgcagaataagaatccgcatcggtacaaactctcaatacatatgttgcataatctgtactacaaggcataatatccttcccctttcaaattttttgaaacaggtttgttattatgacaaaccctccgttcacttctagctggcaaacgtatgacaaagggaatctcatggcttatgagattaaaaattcaaaactcttaaaattaacaaaaggcgcccctcttagcagggcgcctttttcgcgcgattaatcatcactgtttaaaatcccgaaaaaccgaagcaggttgataaacaagttgataaagtcgatataaagcgtcaatgccatcaaaggaatcaggtcagccgtgatgtcccggtgcttgatctggttcagatcgtataagatgtacattgaaaacacaattgttccgatgacggaatacgccatcatggcggcggaattcagcgggctgaaaatattaaatatccccactgcgagaagcgcgataagagcgacaagcaagaaggaccataaaaacgacaagtcctttttcgttttagcgccgatcgtaccgagcaccgcaaaaatgacaaacgaagaaccgaatgcctccaatacgacataggctccggctgcggacgcataatggctgatgatcggaaacagcgtcattccggaaataaaagcgaatgaaaagacaaacacatatccgacggctttttttcggcgcagccaaaatgcggcgatgatcatgacgacctccaagaccgacagcggcagcatcaatgccggcggaatgaactggcccgtatacaggccgattgtcgcaactaacagtgtaaacacaaataccgtgataatgcgctgcataatagattgtttgctctcataagcagcagtttgcatgtcaaaagtcctcccaaaaaatgatcgtgataggtctattataaataaaatgggagaaatttgcatgattttaagaagattttaaggatgtcaggcctgacgtttcgctgcgcactcctgcatatccatgaaatcatgcagttttttcgtcaatccgccgtgcccgaatcggatatttcccttctgccccggcgttttcacgaaatcaaggaatgccagcacataaagacgcctgacgggaatcggaatgacgcccgcatcataaaaccagccgtcaattgtattgagcacgcctttatttatgccgtattgcttcgtgcaccaatgcagaaagcgcacttcgggcaggtgcagataccggctctcccggaaaggaacagttgaatgcttcatatgtaccgcctcctgtcattggctgttttttaagattgttttacttctttgcttttcagggaaaatcgatatttctccaccttatcaatttgtgtcacttgggaattatgaaccgtaatctgaacagtcccgaaatcgagcgtttccagcgcactgataatcttttcgatcacatgcggatctacgtttcctttggacgtcatcatgctcccctttatgtctggacgttcgtcttttgacaatgagtgttttaatccatactattctgataagaaatatataattatactattatgttttcattcagaaatcaacagcatttacacaattttcggatatgttttctttgcgaaaactttcacttcctttgctttgacataaaccgtgtcgccgacgcccgcccccaaggcgtcatattgctgtttttaagaacgcaatcttcacgttccgacatatttaaattgttttccgctgacaaaaaaagcgccccgcctctggacggagcaccttttttctatgcttttgcttcctcgatcacacatgtgacacccatgctggcgagcgcctgctccagagagccgtaagtttgatactctgaaaaatcaagtcccaattggatagaagtctgtgccacatcaggccgaatgccggaaaacacggttctgatgccgaggagaaataacgttttcgacagcatatacaattgctgcgccaccatcgtatcgacaatgggcacaccggacagatcaattacaaggtttgtgatccgtttggcgacacagttttccggcaccgactccaaaatcacacgcgcccgtctcgtatcaatcgcgccgatgagcggcagagtgccgatcgtatccgcgatcaaaataaccggacagctcaattcggaaataagctcctgctgagatgacagcctcgcgatcattaatttctgaaactgttcagtaaaatccgtcatcagctgatcaaacgagccgttgacaaggtaattccagcggcgggcatcctcatttgttacaatgtcctgatgctcatccataaaacgggtgaccgcctcccaaaagacggttcttgaattgccgatcgcctcaacgacctcatgaacctccgcgtcttgctccactctgcttttcgctacctgagcggcccatttttctttgttatgctgaaaaacggccggatcttccaaaaaagcgcttgcgatgaccgtgtttgtaaaggtatgctgctcgatcagcagccgtttcatttcctcacttaattgatccgcagaataaaaacgccctctcagcttccgtctcagcttgagccatttttccgtcagctctgccgaatgtgtaataatataatcatgaagtaattggtctttgttcactgccgtctcctctttcaagaatatgtacttttgtctaaattataaatcggaatcaccgatcgcactagagaaattaaaaaaacctgcacattaagcttttgattgcttttttcggcaggaggatacactataaaagaaatgaaacaggaggtcagtatgatgatcaaaaaaatcgcgacagtcgccgtatacactgatgatcagcaaaaagcgaaaacattctggacggaaaaagcggggtttgaaaccgtcgccgagcatccgatgggaccgggcgccttctggcttgaggtagcgcccaaaggggccgccactcatttggttatttatccgaaatcgatgatgaaaggcgccgagcatatgaaggcttctatcgtatttgagtgtgaagatgtctttgccgcatatgaacagatgaaaaggaacggcatcacctttttagatgaaccgaaacaaatggaatggggcagcttcgtgcaatttaaagatgaggatggtcatgtctttctcctgaaatcgtaatccgtcaggcatcttaattgactttgagaatcattttcatttaaaatgttggataaaacgtaaaaaggattggagagctgccagatgtttgtgcaaatcagaaacatgaccgtaaaagaaggacatgccgacaaagtaatcgaacgcttcagttcagaaggcgtgattgaaaagcaggaaggtttgatagacgtaacggtcctggaaaaaaaagtccgccgcggtgatgaagaagtcgtcgtgttaatccgctgggagtcagaagaccattggaaacaatgggaaaaaagcgaagaccacatcgcggcccacaaagcaaaccaaggcaagccgaaacctgattatatgcttgggacggatgtcggtatgtatcatgtcagagccgttaaaacaggcgtacacgaaaaataataaagagcatttgccccagggcaatgctctttttattttttctcctcaaacggcaggacaaacagcggtttatcgggcttccattccgcatacagcacgtcctccgtttttttgatgttcagctttttcagctcctgattcagctgcttttcttccagcccggcttctttcagattttcatacagcacttcgccgtcaataatcagcgtgaccggcaaagagacttgcttcggctttatttgcatgtcgccgtttttcgtcgtgtcatattgaaatttcggcaggacgctgaccatcccgtttgtttctaaaattgcgtactccgcttcctgtatagaaaagcaattcgcctgtctgagaaggctttgcaattgattaatgtccagcttattctttttcagcacatcatatttcagttttcctttatgtatgataatactcggctcgccctccaacagctttctggagctttttactttctgcgtaatcagttcgatgagataaattaaaaccccccataacagagaagcaaaaatgatttcaataatcctgacgcctttatcatacaccgcatttccgaccagttcgccgaggatgagcgcggaaataaaatcaaacggcgtaatttgtgagaattgagtttttccaagcaattttaaaatcacaaataaaatacccaagccgcatactaactcccaagccactgtaagtaaatgtcccatattcgcaccttcttcttaaaagtcattaccattatggacattcgcctgttttctatacagcggccggcaatacacaaaaaaacgcagacgaggctgcgttttttcacttctgcttactgtttttgattcgatctgacgacccgtaagcatacctcagcggcataaccggcggccgctccggaacccgtaaacatcgcggcaagccccaagcccatgccttcccagccgccgacaccgaaaatgctgtaaacaaccgtaccgaaagcagtcaggcccagcaccgccaaaagccactcaggccacatctttttcggccatttcttacggagcacagccgatacggcaaagttaagacaaaatgcggccagacagatcagataaaaaaaccccatgtcttttgcacctccgtcatgaggagctttttatttgctcacctttttttcaaacaaatgataacccggcgcgagtccttttgattcgtaacccattccgctgtaaaacgactgaagcgccttgtttccggacacgcagtcgagccggattttcgtttttccaggacaagacaccccgtctccgcccaagtcatgatcgtccggccgagccccgcccctgcaaaccgcctgttaatcgccagccggtggagatatacggactcctcatgtccttcatcgccccatagacgtctgtcccacccgcttgcttcgggaagcagcatgacgacgccggccagctcttcattctgcctgaataaaaaaacataccctttggcgatcgcctcccgcatattgtgggtatcttccccttgcagaaggccgctccactggttcgaccctttatcgcgaagccattctgccgcctgcacgagcagatccatgacttcttcttcatcatccttccgggcggaggtgacccggaatgcccccgccttctcctccgtaatcgtaaatggtgtcataaaatcctcctgtaatcagaatattcgacacctttattatagaccaaacgcagaaaggaaaaaaacagccgtcatgtttgagggccgtttaaaaaattttcttcttatcacgttcttcttttaaaatctcaaccgcttccctgaaacgcatagagtgaacgatttcacgctcacgcagaaaacggagtgaatcattcaggtcaggatcatcggaaatatcaataatccattgatacgtcgctctcgccttttcttcagccgcaatatcctcatataaatcagcaatcggatctcccttcgcctgtatgtaagacgctgtgaacggaacgccggccgcattgtgataaaacagcgcgctgtcatggttgacgtaatgatcactgagccctgcatcacgcagctgctccggtgtcgcatcttttgtcagcttataaatcatcgtcgcaatcatttctaaatgcgcaaactcctccgtgccgatatccgtcagcaggccgatcaccttgtcaggaatcgtgtagcgctggtttaagtaccggagcgctgcggccaattcgccgtccgccccgccgtattgttcaatgagaaacttagccagcatcgggttgcacgtactcactttaaccggatactgcagctttttttcatatacccacatttacagatccctccttatacttgccatggccaaggaccgcggccccagtcccattgagcgccggcctgactcacgccgaattgcagaagcggtccgtactcaggctcaaaccgttttctcagctgccttgagtaccgggaatattcatgaaactgctgaagcgcgagacggtcatggggatgcgtatccagataaagcgtcagctccaccaagacaaagtccgccgcctgaatttgctccagcagccgatagtattcatcatcaatctttttcgccatattcgattcccccccgataaggattatcatagaaatcgtaaagatccttccaaagggtcccttttcttaatgcctccatcggagaaaactgctccaagtgataaggctgaaaccgcatataaagatgcggcggcgttctgtagtattttctcccgatcggcgggcagggatcaaaccggctgtggaagggtttataggatttgaccggtgtaaacggctgattttctttcattacgatcctcctttcctaaacacatgaccttaataggtatgaatccgtatcagcatttatgccctgtaagaaaataaaaaagcccgttaaaaacggactccatgcagctcatctggaatttgaagtaaaaaaatcataatgaaaaatctgattgaaagcactgataatgtttcaatgtatattccgtaatttgctgatcatattcaggatattcgtatctcaataaaacagccactgactttgaatatgctctgaagagaccttggcagtcaaacaatgccttccacacgctttcataagtattgccgacataagtattcagcagaatttcccaatctttcgcattcatgtaatgttgaatatacttataattcttccctacacttaatgaaaactgatgctctatcccaatattccacgcaatcatacgcaaaacattaggccttaaaatgtcattcatatggtccagcgcaaacagtatttctttgcgcattaatcctttaatcacataggttgaaaccatccaaaattcattgcagcaatcatcaaactctccgggggtcggtttctttatatgatattgttcatcactcgcaatcatcttactgttgattcggtcatccttgtctaataatatttccgccaaaccatcactctgtgtaaaataatcctctgtttgactcagagggatcaaagttaagtcgattttatgatgatctttaaaaagcatgagataggagaaccagtctccgagttccggagggaaaagttccatatcttcaggtttttgcatcatcattctttcgccaaactgatccagccagctttcatcagatataaaagagtccatatcggtcacaaaataagaaatatcatagtcttgaaatttgtctcgcggtacatttttattggttcttgatccctctaaagtgacaagacggattctctcgtccttcatcgcaatatcaagaatcaatttcatcatttcgtcttcacttctcacatgtaaaacctcccgataaagagatttttacagatcatgcttttcagtttataaacaacttgctcatgatttacagaaatgtcatatgtacttgatgattttgctccaatcgtaccacagctgcaagaacatgagaagagcactcttgctgttccaagagtgcttttcccgaatggtcagatatattggctgtcccgatgatgatggtgatggaacgggtagccgccgtagcctccgccatagccgccaaaaccgtaccccggatatcctccgaagccgccgtagccgccaaaaccgccgtaaccgccgtaaccgccgtaaccgccgtaaccgccaaaaccgtaccccgggtagccgtagcctccgccgaaaccgtatcccggatatcctccgaagccgccgtagccaccgtagccgccaaaaccgtaccccgggtagcctccgtagccgccatagcctccgccgtaaatcggtcttctttcattcatgatttatcgctccttcacataggttacagtccagtttatgacatgcggaaggaaacgtatgggcatccgcccagttttggcgaaataatcaataattgcttacggagaaatacgatacaggccggccgcataagcaaaataaaaaggccggaacttatgccgccccggcctttttgtctttattcgcctaaatctacattgtgataaacctgctgtacgtcttcgaggtcttccagcacatcgatcagcttttcgaattgagctttcgcatcttccggaagctcgacttcattttgcgcaagcatcgtcagctccgcaaccgtgaactcttcaacgccggcatttttgaatgcctcctgcacggcatggaattgatcaggctcagcatacacgataacactgtcatcctcttctaaaatatcgcgcacgtccacatcagcttccatcagcaattccagcgcttcatccgccgtcttgccttcaacgccgataacggcggtcgcatcaaacatgtaagcgacagacccgctcacacccatatttccgccgtttttcccgaatgcggcgcgcacttcaggcgccgtgcggtttacattattcgttaacgcatcaacgatgatcattgaaccgttcggcccgaaaccttcgtaacgcagctcgtcaaagttctcctccgcgccgcctttcgccttttcaatcgcacgctcaataatatttttcggcacactgtacgtcttcgcgcgctcaagcaccacttttaacgcctggttcgattccggatctggctcgccttgttttgccgccacataaatctcacggccgaacttcgcgtaaatccggctcgtatttgcgtcctttgatgctttcttttctttgatattgttccacttacggcccattttgttccactctctttcacgaattgaatctgtatgataaatactctgcttctattatacctcagcggttgggttgtttcgagtgtaagacattagaaaaaacaggcacgcttaaaatcaccggagcgcagtaagccgaatttgaggattattgtacaaaacataaaaaagcctcccttcatacaggaaggaagtcgcaagtcaaaagattcattttattcttattacctatttcctacactgtatatcctgactcccgtggtaaaattttgatatcgaacaaaagaaaggatatggtcatgaaagttttcgaagcaaccaccctgctggccgctgccaaacagcgcgcgggtgaatacaaaaaactgcgcggtcagatggttaatctgaaaaaagcatttcaaggcgtggctgatctcggtgacggcgatttctctggtcggggcgcagataacatcaaagcctttttccaggaccacgccggcgtcacagacagctggcttgatctgatcgacatgaaaatcgcatttctcacaagccttcccggtaaggtcgaagatgccggactttccaattcgcatgtggaggaatcatttctggagcatgagctcacccacgccctcagtaaatcaaaggcgattatggaagagcagaaaaaggacatgcgctccatcctcggtgagatcgatgacatcatctcgcttgatctgttttcaacggaaagcacagatcagaagctttcttcagctgacaaaaaaagaagcgaaacgatacataagctcggcaagcttgatcacgatctaacgaaagaatacgcagaaaccgaagcgaacgaacagttcatccaagctgacttccagcagcttcaaaatgccacgggcaaaggaaaaagcgccacgccgcttcactacaacgccaaggcgtaccgtgaaagcgacatccataagaaaaaaggcgagattgcaagacattcggatgcttatttgaagatgaagaaagaggaagcgaaggaacgagagattgaaaaactgaaagaaagactgaaaaactacgattatgcgaatgctgatgaattctactcaatggccaaaacaatcggctataaaaacctgacaaaagaacagcagcgctacttcactcaaattgaaaacacgcgtgaacttacagacggtttcaaaggcgttgccgtcggcctttatgattccggaaaagacgcggtcacaggcctgtgggatattgtcacagatccgggcggaacggttgaagccattacaggagcggcggctcacccgatcaagacgtatgaagccatttcagcggcaatcgaagaatcgtaccaaaaagacatggtgaatggcgacacctactcaagagcaagatgggtgtcatatgcagtgggcaccgttgtgacatcagttgtcggcacaaaaggcgtcggcgccgtctcaaaaacaggaacagccgccaaagtgacaaccaaagtcaaaacagcagcacgcaaatccgccgcagcacaaaaagcgataacggtctcaaaacaaaccgttgatcacatcaaacaaaaagtaaacacaggcatagaagtatcaaaaaaacgtgtcaaaaccaagttacatcaaatcggagatctcaccctggctgatattctcccgtatcatccgcgtcacgacgtagtgccggcgggcgttccttacaacgcagtcaacggggtcacacttaaagaaggacttcagaaattcgccaaggtcatcctgccgaaaccgtacggaacctccgcaagcggcagacggacaccggcaccgcatgtaccgccggtaacggtcaaatacggcgagcattttgcgaaatggaccagaaagaaagtattgaagccgaatgtcatctataaaacaaaagaaggctacacgtacaccactgacaactatggtagaattacaagtgtcaaagcagacttgcagctgggagaagcaaaacgcaaccaatatgcgcaatcaaaagcaggtaaaccagaccgtctgacagatgacgacggaggccacctaatcgccacccaattcaaaggctcaggccaattcgacaacatcgtgccgatgaattctcagattaataggagcggcgggaaatggtacaaaatggagcaagattgggcatcggctttgcaagcagaccctccccaaaaagtatcagttgaaattaatgcattgtataaaggtgattcattaagacctactgcttttagggtgaaatataaaattggtgatcaagaagctaaacttatgagaatcaaaaatcaggccggaggttaatatggagacaaaaaaaatggggcaattatatcaaaagatagcagaaagcattaatgagatcattccatctgaatgggaaagagttattctttatgcagaaatacttgacgattcatctgaagttttcttttatttcaatactccacatagtgaagattttatatattctcataatatccctgaacactatcatgtcagtgaggagatttatgaggagctgttatttgacttgcatgacttattcgaggaattacgagatgaatttaaagaaaacaatcaagatatatggactaatctaacacttaatctggggataagcggagaattttcgatagactataattatgaagacgttattcaatctccatataccatctctcaaagacaaacaatctggacttataaaaatgtaggaatttatcctaagagtaaacctttaaaatcctttttagaacagtatttaaattctcaaaattaaaattccccctcctttattggggggtttttttgatacaaatgatccttacaaattaccaattataatgctggaggctgatccttgttggaaaatgaattaaatgcattatatagaaacatagctgaaatcgttaacgaaatgataccagaaccatgggagaaatttttgttctatgctcagattcagagacaggcggaggcacttactttttttacaattctcaaaatgaacctaattattttaagtacagtcttgaaattccgtttgaatttgatattgacgaaaatgaattcgatcagtatgagatggaattatttaaactaagcgaaaaaatgagagatgttttcaaagatcatgatcaagaattattttattctttcactcttagcctagaaagatccggaaaattaactgtcaactttgattatacagattggtttaagacagattatagtttcagtgatcagcttatcatctggaaattcaaatacttaagggaagaacctaaggatccatcattacaaaaattaataaaaaaatatttagatgaatatcctgaaaatccaatttaataaagttgggataatgatgttagaaaaagcttatctaaaaataactgatgtcttaggaaaaataattccttctgaatggagcaaagttgttctgtatgcagaaatactagacggttccagagaagtttattttttctttcaaacacccgaaaacgatgaatatatatactctcatgacataccagaacaatttcaggtcagtaaaaaaatttataccggactactactagacctccaagagttgtttatgcagttacacactgaatttaaagaaaataaccctaaagcatggacaaatttgacactgaatcttgaaagcgatggaacgttctcaattgattatgattatgaagatgttattgaatctgatttggacgaatacgaaagacaaatgatttgggagttcaataacttggggattttccctgaagacgaagaggacaaagaatttgttaaggattatctaaatattaaataatgctatcaacaaaggtagaggatcatcaatggtagctgaaaaaatggaacaactatatcaaaagattgctgaacatctaaatgaaatgattccatctcaatgggaaaagatcgttttatatgctgaaatacttgatgactcagcggatatatacttttattttacaacaccaactaatggtgattacttatattctcattatatacctgaacaatttaaagtaagcgaagagatttacgatcaactgctgattgaacttcaagagctatttgaagaactaaaagaagaatttaaactaggcaaccaagatatttggactaatctcactttaaaattagaaaacaccggaaagttttcaattgattataacgatgaggatgttttattgtctgaacttgatgaccttcaaagacgagatgtttggaaatatcaaaatttagggattttgcctaaagatgaggacgatagaaaattcatagaagagtatctaaacatataataagctttcaaacggctaaaaaaaattaaaaaggattctgatattgtggaaactgaaaaaatgggcgaactatatcaaaaaatcgctgagcaaataaatgaaattatcccctctgagtgggagaaggttgctctttatgccgaaattttagatgattcttcagaagtttacttcttctttagtactccacaaaatcaggaatatatatattcacacgatattcctgaacattttaatgttgatgaagatatatatgacgaacttctatatgaattgcaagattactttgaagagttacgggatcaatttaaaacaaacaacgaggacttatggacaaacctcactttgcatctcgaacgaagcggtaaattcttctcaattgactacgattacaccgatgtcatcgcctcagacttaaacggaacacaacggcaagtggtatgggaatatcaaaacttggggattttgcctgaagatgaggacgataaagaatttgtaataaactacgtcggtctataagtcaataatggctcagcacttccttgctgggctattttttataactacatcataccttatgaatgggcaaaaatatatctttatgcagaagtattagatgactctcccatggttctctttcacttcaagacaccaaaaaaacgtcaactgatttattcgcaagatctaccagcctgatacagtgtaaataaagatatcttcaacacttttcaagagaaatccgagaactttttgaggaattaagaattgagcacaaaaagaataatgataaacaaaacaggcagcatccagtaaacggatgctgcctgttacatcgttatgtatcgtctgaagaagtcatttattttgttttttaaatatgaaaatagatatgacggtaaatatgatggctgtaatgacaatgacccacaagctcgcagccgtactgataaaatggccgtttaacttgtagacgatcccgtaatgcttttcatattcctgtatttggtccgcagaagcatgtttaaacactttatcaactgagtctgtcataaacgcttttctgaacagaacggcggtgtggctgatagggaaatacataataatcttctgcacaaacaccggtacgccgccgatcggtacatatactccgcataaaaaaccgatggctgttccgacaatcgtacttaacgtcgaaaatgcattttgtgtgtgaataaacagcgttaaaaataaatttatggaactcgagagtgcaactgaaagaataatgatccccaatacttcaagtatatctgtaccgcttaaaagcttgctgcctgttgaaacgagaaaaatttcacagcctaaaaaggcgatgaaagaaaagatcaagccgatgacaaatgaatgaatgacatagctcaattggatggtcgcccttgataaaggagctgttaaaaagtcatacgttctcttgctttctttatctttcaccataattccgaaagcgcctaaagtcgttgtcacagctgtaatggacagcaatcccgccaccatccattcgttcaccattgctttggaatcatctgtcgaaccgaccagggccttaatggcgtccagctgtgtctgctgtaagaacacggcatataacagaatgacgataaatactgacagcaaagagagaagcaaaagcgttcgatcacggaagtatatttttatatttctgctgattaaactggataaagacttcatttatgcaatgctcccctttactggcaaactgcttccttgttcttcgataatatggataaacacatcatccatatttcctttaatcacttcgaaagattcaatttttccttcaagacctttcaaaatgtcaaacgcttggagagtggactctacacgaagggaataaatagagtttttaaccgtaaaatccagttgtttattttcaaaccatgccgtcggatcaacgccttgcttaaacatcatatgcagactgtcaaacgcatattgatctttgagctgactcggtgtaccctctgcgatcaggcgtccttctttgatgaccacaacgttatcagccacagcggcctcctccatgtaatgggtcgttaaaaagatcgtcatgtttgtttcttcctgcagccttttaatcgcattccaaacaaatactctcgtttgcggatcaagacctgtagtaggctcatctaaaaataatatagtcggtttatggatgatggcacgggcaatatccgctcttcttctttgtcctcctgacaaatcgctgtattttttctccttaatatcatccaattttaaatagtctgttacaaactgatagttctcttgcacttgtgccttgcttaaatgataatattgtccgcggttcatgatattttcataaacggtcaatcgttcatccaaaatgctctcttggaaaacaactccgatctttttgcggatatgattattctctttcccctcaccaagagtataaccatctattaccacttttccggatgtctttttaatcagcgtacagagaatatcgatagtggtcgatttccctgcaccgttcgttcccagaaatgcaaacagctcgccgcgtttgacagaaaaggatacccctttcactgcttcaaatgatccatattttttgcgcagatcggttactgtaataatgtcttgttcttctcccattctgttcacctcgaaaaataagattctataccgttgttcactaactttatatcgtcattcccgccaggattttctcatttttatccaaatttattatctttttataaataattatcttgattatgaagatatacgtacataaaaaggcttcttaaaagaagccttttatcgctttacgttaatattatgctttcattccccaagtcattaacaatcgccactttgttaagaagctttgtaaggatctcctacacaaatagatttttcttttcctgcaacaacggtagaaatcctagtcgcattcgttaaaaagcctttaacagttgtcgcaaaatcttgcctccctgctttttaaaggtacaagatcatagcgtgattttttcccaattccgttttaataaataattaaaaaaggtttcatttgtgcttatatgtggctttttcttcagcaactgatgaagacttaaagaactcattctctttgtaattcatttgcatatgtttcagccttttaaaaaagtaattttctaattgtttgtctatacaataaataaaacagcctttttgtccccgggtcatcaaagttctgtatgtgttgcgaataatttcgtctgcaagcttctcagcttcttctgaattttgctttagcattttcttcaaaccacgtaaggaggtatctgttttcgcccgctttgaatgatcagtcaatactactccgtccctgcacactagatcatttcctataattacacctacataatcaaattccaaaccttggcatgtgtgtatacaacctatttcattaatagaatcttcatcaattgcccacgtgtctgagttatttaaattccaactcattccgaattgatattcaggaatctcgatatcatgaaattctgttttagctttgccttccttcacccaatcccaacagtaaccagcaactattcgagctttattattaactttattcagatcttctatctgtttacgcaattcatttggatttctatatatacgaaaatcgtagttcattccaatataattagaattcgcagtttcccgaatttgaagaacatcatctaaccagcttatataaccatctgaaccattgcaacgaaactgtgaatccagtttcatatttgtaacctgagcatctaattcttttgagaatttaaggattgtatcagtgctaccaatatcttttaatgttactctttgatgttcgtctatgaaaaaaacagaaagtttggaagcatttattatttccttaatttgattttccccaaggttattaaataaaccggatttctcatttaatcgatgcgcctcatcaacaattaaaacgtcaaattcacctgatggagcattgacataactgcccgatcctttaaataaattatcaatgtgccctttccgaaagttttgttttaacttagtagcatatatatttctgggagctgcattttttgttacatattgtgccacaagacttcggtttgttgcttctactaataaatttatagcaagaacagattttcctgtacctggtccgccttctacaattaatacttttttagtgtttgtacgtaatgcctcattcgccaaatgtaaagccgtctcatacacaactttttgattatcaatcatcataaattctcgattaccttgaagcatactgtttaacgaatcttgaagagactttgaaggccttattcttcctttatctattgtatataggatttctttgttgtctccatacttaatatactttttaatgaaatcacgaagcttacctgaatcacctttgataaaaacaggagcttcttttatataatattcatatattgaatcagttaatggatcgtctgtaccctgattcaagtagttatgtaagtatgcacaaggatatagcttgatatcttctttttgcgcattttcattgtaatcctttattaacgaagcgtatgaccaggcttgataggatgggtgggttgtttcgcgaattcctttatttataaacgttttaacgatggcctctttactatcaattttctctactttctcccattgtttaagttccacaatcacaacagatgaacgatcatccttatctgatccagatataagaaaatcaatacgctttgaagtatggggtattttgaactcaatagcaattcctgcgtccttaggaatttctctatcacttaataccctatacatatactgcatagagttatcccaagatctaacctctttctcattgattttgccaatcttatcattatagtttttacagatattcgtcaccaaattgtcgtcaaacacatcactcagaaactcttcttttgtagcttcatagactatcattgtttcaccttttcattaactttttgcgttatctctataaattcgccgctcaaaataactaaattgagctatattgagaataccatttttcttcaaattaatctgttttaatatgacctttgtacttaataattaaaaaggatccttcacatattaatataaaaagcagcgttctccaaaagagaacactgctttatttcaatactagctttgccacacactccacatgattcgtatgcgggaacatatccaccggctgcacttcgagcgtctgatacccgccatcctcaagcacccgcaggtctcttgcaagcgtgcctggattgcaggacacatacaccacccgcttcggtttcatgtcgatgattgtccgcaggagggcttcgtcgcagccttttcttggcgggtcgacgacgagcgtatcggccgtgatgccttcttcataccatttcggaatgacggtttccgcttctccgactgcgaattccgcgtttgtgatgccgttcagctcagcgttgcgtttcgcatcctcgatggcttccggcacgatttcgacgccgtacacttttttcgcctgcttcgccagaaatagagaaatggtaccgatgccgcagtaggcgtcgatgacggtttcttctccttgcagctctgcgtactcaagcgctttgtcgtagagcacttttgtctgttccgggttgacctgatagaacgatctggcggagatggcgaatttgacgtctccgatgaggtcgtagatgtattcttcgccccagatgacgtttgtttcgtccccaaaaatgacgtttgttttatttgggttgatgttttgcacgatcgatttgacgtgcgggaattgcgccgtaatgtctttgatgatcttcgctttgtgcggaaaatcgcttgttcttgtgatgaagacgatcatcatttcgcccgtgacgacgccgtatctgaccatgatgtggcgaagccagcctttgtggcgttcttcgttataggctttgacaccgtatgctgcacagatgtctttgacggcttggacggcttcatcgtttttggattgctgaatcaggcaggcgctcatgtcgatgatgtcatggcttctttgctgatagaatccggcgacgagtccgccttctctttctcctaccggcacctgcgctttgtttctgtagttccacgggtcttccatgccgagcgtcgggtgcacggtgacgtttgagaggtccagcttgccgatccgttctaagacgtctttgacttgtttctgtttaaacaagagctggccttcataggtcatgtgctgaagctggcagccgccgcattgcttgtagatcgggcacggggcatccgttctgtgcgggctttcttccttcagctcgatcaaacggccgaaagcgaagccttttttgacgcgtgtcactttaatttgcgctttttcctcaggcagggcgttcggcacgaagatcgggaagccctgaacctttgcgacgcccgctccttcatgcgtcaaatcctcaaatgtcacgtcatagtattcatttttttctatcgggggtttcattttcatctataatcacctctcgttttaccaaaagccttgtttcagcgtgctggcaaaccttcaaattcaatgtcagccttcaaaggtttccgatcacgctgaaaagatgacaaaatcctaaaacgaatactgttttaggattttgtccgcgtattagtcatccagctgttccgctttctccttcggcatgatgacgtgaatatgccggtacagattcacgaattcgcccggcagcatgccgccgtattcgccgtccaggttcagctgcatcttttctgatacattgactttcacacggttcgcttttgtgtaaataatgtgctgatcgttaatatgatcgcctctgagcgccatgctcgcgactctgataaactccgcgagattggcttttttcaaaataattaaatcaaacatgccgtcattcaggctggaatcaggggccagcttctcgaatccgccgaccgagttggtcagcgtcactaaaaacagcataatttcgccttgaaacagcttgccgtcatattcaatctcgacttctgtcggtcgaagtgaaggcaacatttccattccctttaaataataagcaagctggccgagcatcgttttcagtttgcttggcacatcgtacgtcagctccgtcagacggcctccgccggcgatgttgataaaatactgaccattcacctgtccgatgtcgatcgggcgggccacgccgttaatgacggtatcagcggcattcagtatattctctctcggaatgcccagcgctctggcgaaatcatttgtcgtgccgaccggaatgatgccgagtgtcgggcgtttgtctaacggcgcaagaccgttgacgacttcattaatcgttccgtctccgccggctgcgacaatcaggtcaaactcccgcaaagcggcttctgttgcggcgtgggtggcatcccccgcgcatgtggtggcatgggtggaggtttcataaccggcttgttcaaatttttgcaggacctgggcaagatttttcttgaaaagctcccgtcctgaagtcggattgtatattatgcgtgcacgtttcattatctcatcatcctacttaagagtatccgatccattattaacactaacaacctttaattatactatgacttgagaaaatcgcaacaatatgtacaggaattgccagaagaaaaaaggccccggctccgtttaaggagccaaggcccgctgtcttactcttcttccgttccaggttttttcttacggaatttcgctaatacttcatatacgatcggcacaatcagaagagtcagcagagtcgaactgattaaaccgccgataacggtgacaccgagtcctttagaaatgacctggcttccgccttcaaagcccaatgccaatggaagcagggcgccgattgtcgcgatcgccgtcatcagaatcggacgcaatctcgtagagccggcttccaggagcgcttctctcgtcgataggccttccgcttctttatggatgacgcggtcaattaagacaatcgcgtttgtgacgacgattccgatcagcatcagcataccgatcatggcattcagactgaccgtctctccggatacatacagtccgactaatgcgccgatgactgtaaacggaagcgagaacagaatcgcaaacggcgctaatgctccgccgaacgtgatcacaagaacgaggtatacgatggcgattgcggcaagcatcgctaacccgagtttcgtaaaggaatctgcaatatccgctgatacaccgccggtatcaatcgatacattgtccggcttatccagtttgtcaactttcttttgaacggctgatgacaccttcgtgacgttgtcagaagtgacggttgccgttacgtcagcgtacactttgccgtcgcgtttggaaatggtatcggatgtcgtgccgtttttcactttcgccacatcgccgattttcacttcttggcctgcaggtgatgtgatggttttatcctctaattcttttacactcttatactggtctttttctgttttgatgttgacgtcaagctctttgccgtcttttttcaccgttgtcaaaggagactgtgacgtttgggacatcagggcttgggagatttgcgaagccgtcaggccctgcttgctgagtttctcctggtcagcgacgaacgtgtactcatcatatgtgctggaaaggcctgagttgacgtctttcagatccttctcctttttcatgatgccttcgatgtctttgaccgtgcctttaatatcagactctgaatctccgtacacatagtacgttaattcgttgttgttgcctgacgaactgaaattttgtgatttccattcgccgcggctcgatgtttttttgatttcttttaagacattgtctttttctttgtcaaaatcaggcgtgtcatcctcgtatttcacgtagaacaatgcgccgtttgagcttccgccgagcggactttgcgatcctaaagaatactgaacagtatcgacatgtttgcgtttaagcagcatatcttccgctttttgcgcagctttttcagcttcgcttttcgtttcgcccggttcaggcgtgtatgtgagctgcatcgttttgtccgcttgcgcaggcaggtagctcgcgccgatcagaggtacgaggaacaaactgccgacaagcatcagaaccgcgatgatagatgtaatccatttatggcttaatgaccaattcagcacttttttatagaaattggccaatctgcccggcttatgctctttcgctttaacaggtgcgcctgtgagcgattttttgaataagctgtgcgcaagcatcggcaccagtgtgatcgaaatcaacagtgatgcggcaagcgcgaagacgattgttaaggcaaacggcataaacagttcgccgatctgtccgccgaccatggcaagcggcaggaatacggcaatggttacgatcgttgatgacatgatcggtttaaacatttcttttgtcgcttcacgcaccaattgcttcccgcgtaaaggttcatctttcagcctcatgcggcggtaaatgttttcgatcacgacaatcgagtcgtcgactacccgtccgatggcgaccgtcatcgcaccgagcgtcattatgttcaatgtgacatcaagctgattcagcacaagaagtgcaatcagcagtgacagcgggatggaaacgatagaaatcatcgttgatttaatatctcttaagaataagagaatgatcacgaccgcaaaaatcgcgccgaaaatcgctttgcttaacatcgtatccactgactctgtaatcggctctgccatatcaagagtcgagctgtacttgaaccctttatggtcttttttgtattgattcagttcatctttaatcgcatcggccacttctaccgtgttggcgtcattggcttttacgatattaattccgatgctgtcctttccgttcgtgcgggaaatggattcagcttttttcacatctttaatgtcggcaatgtcagagagcttgactgtcggcacccctgctgacgcgctttgctgtgcctgctgcatagcctgagcgtccgccgcagatgccgcaccggctccgcccgcttgaccttgagcggcagaagaagatgtgaccggaattctcatctctttcagatctttaattgacgtaatatttccgttaacgacaactgatttttctttgttgccgaatgtgtacaatccaagcggcgtattgacgtcagagccttggatcactttcttgacggtatcttcatcaagtccgtactctttcatttttttatctttgaaagagaattccacctgctcttcctgctgtccggaaacttgtacggacgcaacgccctgaatgccttcaagcttaggaacgagagtgttttccacatttttagtcagatcttcaagcgagcttttgccgcttgtcacactgagcgtcaaaatcgggaaagagttgagactgtaacgggaaatgtcaggttttttcgcgtcatcaggaaggctgacactgtccagcgcttcagcgacttcggttttcgccttgtccatatccttgttgtaatcatattcaatcataaccgatgagacgttttcagaggatgtggacgttacgacgctcactccttctaaattctgcaccgcctgctcgatcggttttgtcacgtcatccgcaacttgactcggagcagctccgggataagtcgtatttactgagaggtaaggcatgttgacgtccggtatggattcctgcttcatattcagaccggcatacagccctgctacagtaacgataatcgtcatcagccaaactgcgaatttgttcttcagtacaaagttaataatgtggttcatcatgtcctccgttaatttttattgactgactggtcattctatataatactaaacggtataactcaacatcgtcaactaataaggcagtaaatttttctaaatttttcaggattaaggggaagcacgtcatgaacgaaaaaaaagagaaaatcataaaaacaggcatccatttatttgccaaaaaagggttttcttcaacaaccattcaggaaatcgccggtgaatgcggaatttcaaaaggggccttctatcttcattttaaatcaaaagaagaccttttgctctcagcatgtgagtattacatcggcatgtctatggaagaaataaagaaaatcaaaacagaacatcagcataaatcgcctaaggacgtattccgaaaacaaatcgcttatcaattccaggaatttatggagcacaaggactttatcattctcttgctgagcgaaaaggtcattcctgaaaatcaaaaggtcaaacagtattttcatgaggccaatattcaatttaacatactgtaccgggatgctttgctctccgtttacagagatgccgtcataccgtttatagcggatgcgtccgttatggcgcaaggaatagtgagctcctatattcatttcttgatttttaatgaacatacggcattccggacggaaaacgtggcggcctttctgattgccagaatcgatgacctgattacgggactgataagagacaatcccgatccgctgctgccgcaggatatcttcactcagccggcggcggacagagaaagactgcttgcggatattcaaaagataaaagcacagcagggctgcctgaggacgtcctcgtatcgcttgaagtcattgaagaggaatacgcaaaggaagagccgcgaaaaccgattattaaaggaatgctgtccaacttggcaggcagcggaaatgagcagattgaaacgctgcgggcttccattgaaacctatttcagcttataaaaaaagagaccggcgcttaccggtctccgtgtcagcagcgcccttagaggcggctgctttttttatcgttttttgatttcttcaagtaagatcttgttgaccatcggcgggttggcctgtccttttgaggctttcataatctgcccgacaaggaagccgatcgcgcggtcttttccgtttttgaagtcttcaattgactgcgggttgctgtcaagcgcatctgttaccagcttcagaagcacgctttcgtcagaaatctgcacgaggcctttttctttaacgattttttctgcgtcgccgcctttttcaattaattctttaaagactttcttcgcgattttggacgagatggttcctttttcaatcagcttaatcatgccggcaaggccttcaggagtcagtgcgacatcctcaagctctttttgttcggcattcaggtaagctgacacttcacccatcagccagtttgatgcctgcttggcttccgcgcctttattgaccgtttcttcgaagaaatcagccatttctttcgtcagcgtcagaaccattgcgtcataggccggcagaccgagctcttcgatataacgcttgcggcgctcgtccggaagctcaggaatggttgctcttacgcgttctttccattcgtcatcaatgtagagctcgacaaggtcaggctcagggaaataacgatagtcgtccgaaccttctttgacacgcatcaaaatggtttttttcgtcgcttcatcgtagcggcgcgtctcctgctgaatgactccgcctgacagaagcacctgctcttggcgtttctcttcatgctcaagtcctttttgcacgaacgcgaaggaattcaggtttttcagctccgtttttgtgccgaatttctcctggccgatcggacggagggaaatgttggcgtcacagcgcagtgaaccttcttccattttacagtcggaaacacctgtgtattggataattgatttcagcttttcgagatatgcgtaagcttcctcaggtgtgcggatatccggctcagatacaatctcgacaagcggcgtgccctggcggttgaagtcaacgagggaatagccgtcgcccgtatgcgtcagttttcccgcatcttcttcaaggtgaagacgggtaatgccgatttttttcgtttttccgccgacttcgatttcaatccagccgttttcgccgatcggcttgtcaaattgagatatttgatatgccttcgggttgtccgggtagaaatagttttttcggtcaaacttcgtatccgttgcgatttcacagttcaaagccattgcggctttcatcgcgaattcgaccgcttctttgttcaaaacgggcagcacgccgggatagccgaggtcgatgacgcttgtttgggtattcgcttccgcgccgaatggcgtcggtgagcttgagaaaattttagattttgtttttaattccacatggacttcaagtccgattaccgtttcaaagttcacttcatttcaccccttacagttcaggtttcgctttatgatgatctgttgcctgctcaaaagcatgagcgacgcggtatacagtgctctcatcgaagtgttttccgatgatttgcagtccgagcggcagtccgtccgcaaatccgcatggcacgctgattcccggcacacccgcgaggttgacagggatcgttaaaatatcgttggcgtacattgtgagcggatcgctggttttttcgccgattttgaatgccggtgtcggcgttgtcggtccgacgatgacatcgtatttctcaaatacgtcttcaaaatcttttttaataagcgtgcgcactttttgcgcttttttgtaatacgcgtcatagtagccggagctgagcgcgaaggtgccgagcatgatgcggcgctttacttcgttgccgaagccttctgagcgtgtctgtttataaaggtcgatcaggttgtccgcattgtctgagcggtagccgtagcggatgccgtcaaagcgcgcaaggtttgcagacgcttcggaagaagaaagcagataatacgttgcaagcgcgtatttgctgtgcggcagagatacttcttcccatgtcgctccgaggtcttcaagcacttttaaagcggctaaaaccgattctttcgcttctttgccgacgccttctccgagatattctttcggcacggcgatttttaagcctttaatatcgccagttaatgaagaaagaaagtccggcacttcgacattggcgctcgtagagtccattttgtccgggcctgaaatcgcctgaagcaggaatgcgttatcttctacgtttcttgtgatcggtccgatctggtcaagtgaagacgcaaaagcgaccaaaccgtaacgtgacacgcgtccgtatgtaggctttaatccgacgacgccgcagaaagaagccggctgacggatggagccgcccgtatcagatccgagtgaaaacggcacttctccggctgcaaccgcagctgcggaaccgccgcttgatccgccgggaaccgtatcgagattccaagggtttttcgtcgctttgtacgcggagttttcagtagaagaacccatcgcgaactcgtccatattcagcttcccgattgtgacggcttcagcggcttgaaggcgttccacaaccgtcgcatcgtaaatcggatcgaagttttcgaggattttgcttgagcatgttgtgcgaagccctttggtcacgatgttgtctttgacgccgatcggcattccgaagagaagaccgtgttcagaccgtccgtcaaccgcttcgtcaagttctttcgcgtaagcgcgggctctttcttcatcaagctgtaaaaacgcctgcaccttatcatccacggatgcgatccgtttgtaagattcatcaacaagatcggaaatcttgatttcttttttatgtatcatttgtttcagttctgtgattttgtgatcaaataatgacatactgtctccctcctttaatccagaatagatggcacacggacatagccgtctttatgatcgggagcatttttcatgacatcctcgaccggaaggcctttacccgcttcatcttctctcattacgtttttcattttcagcacgtgtgttgtcggttccacgttatccgtgtccacttcattaagctcctcggcaaacgagatgatgctgtcaagctgttctgtgaacatttcagcttcttcatccgtaatggcgagtctcgccaaatgagcgacatgctttacttcttctatagaaattcgtgacataagatccacctccgcataattctccgtttcgtcatataatactgatcatatcaaaaacgagccctctaaagcaacaaaacgccgccttctgaggcatgatgaaaccctctctattttatcctaaatcggggagaaagagaaacgaattatatgtcagaaaatttttacttttataatttattggtagcgctttcttctttaagctgttctaggttggcggggattttttccttgagcgggccaggtttcgagagttgattgatcggggatactttgttaggtttagtaaccatagccggcactaaatcatgcgatccccatcgaaagatgactaaaggcaggctggatcgccggcactactaatctacagaggtgatgcaacatttacatgaaagaagagagggtccaaaaacgtgagtattgaattaattatatctcttggcatttactttgccgccatgctgttaatcggctggtacgcattcagaaagacaacgaatattaatgattacatgctgggcggaagaggactcggtccgttcgtaacggcgctgtccgcaggtgcggcggatatgagcgcatggatgctgatgggagttcccggcgcaatgttcgcaacggggttatcgaccttatggctggcgctcggtttgacgatcggcgcgtattcaaattatctgctgcttgctccgaggctgcgcgcttacacggaagttgcggatgatgcgattacgattcccgattttttcgataaacgattccgccactcgtcatcattgctgaaaattgtttccgccgtgattattatgatctttttcacactgtacacatcgtccgggatggtatccggaggcaggttatttgaatcggcattcggcgccgactacaaattcggtttgtttttaacggcgggtgtagttgtgctttatacgctgtttggcggtttcctcgctgtcagtctgactgactttgtacagggagcgatcatgtttgcggcattagtgcttgtgccgatcgttgcttttacccagctcgggagcgtttcaacgacgattgattcgatcaacgccgttaacccgaaactattggatatctttaaaggcgcgagcgtcattagcattatttcttatttggcatggggactcggctattacggccagcctcatatcatcgtacgatttatggcgattaaagaagtgaaagatttaaaacccgcccgcagaatcgggatgagctggatgtttatttcagttgtcggctcattgctgaccgggattatcggggttgcgtattctcatcacttcggggtctccgtaaaagatccggaaacgattttcattattttttctaaaatcttgttccatccgctgattacgggcttcttgctgtccgcgattttagcggcgatcatgagttccatttcctcacagcttctcgtaacggcaagcgccattacggaagatttataccgcgcctttttcagacgggaagcgagcgataaagaattggtcatgaccggacgcctgtcggtattgatcgtggccgttatcgccatcctgctttccatgaatccgaacagcaccattcttgatctggtcggatatgcgtgggctggcttcggttcggctatcggccccgcgctcttgctcagtctgtactggaaacggatgaatgaatggggagcgcttgcggcgatgattaccggggccgcggccgttttaatctggattacgacagggcttgccgcttcaaccggcgtatacgaaatcattccggggttcttcctcagtctgattgccggtattgccgtcagcctgctgaccaaaaaaccggccgatgcttcttatcagctgttcagccggatggaagctcttttgaaaaacaagaaatagacaaaaagccgtcagattttatccctgacggcttttttcttccgcacttgtcctgctataaatactgtgagaaaatcatatcaatttattataagaaaaattgcggaggtgctgtgcaaattgagctggcctatcgaaccagacattttattaaagctgggcattgccacgctgatcggcatgatcatcggtcttgaacgcgaactgaaaaacaaaccgctcggactgaaaacctgtattgtcatcgccgtcagctcctgtatgctgacgatcgtcagcattaatgcagcatatcatttcccgaaatattaccgtatcatgatggatccgctccgccttcccgcccaaatcatttccggcgtcggttttatcggcgcgggcgtgatcctgcgtaaaagcaatgacgtcatatccggcctgacgacatcggctatcatctggggcgcggccgggctgggtctggctacaggcgccggcttttataaagaggcgttcgcaagcctcttgtttatcctgatcagtgtcgaatttcttccgtggctgatcagaaaaatcggtcccaatcgcttgaaggaaaaggatatccgcgtgagaatgtctctttccgataaagacaaaatgaccgagattttaaaggaaatgaaaagcaaacagctccgcattcactccgtccggattgatgacctgggtgaaaaagaatttccgattatggaagtgaaagtcagtgttcataaaaaccgctacaccactgacgtctattatgatattaaagaaattcagggcgtcgtcggagtaaaatgtgatacgttataaaaaacgccgggctggattcagccggcgtttttctatttatacgaatgcagaaaattgatactccgtaatcggtgtttcattttcgatatcgcgcctgaaggctttcagcatcccgagttcctcgtccccgagtgaattgaggtcaaacgcctgatgcaataatccgtagatcagcatatggcgcagccggaggaaatccgggatgtgttcaaaccatgcggaatcaaggtcattttcttccctgtagcctttcataaagtgagtcatgaattcacccgtaaacgcggccttgtcttcatacgggatgaccggataccacaacatgttgtacagcagaatactgatatcattcacaaaccaattgtagccgatatcatcaaaatcaaatgcagtgatttttccgttgtcccaattaaaattgccatgatgcagatcggcgtgcacaaggccgtagttttcaggattcttcggcaaacggcgcagtttttccattagagcatccgcccgctcaaatacgagatgctgatctgcgggcacgtattttctcagcttcagctgctcctcttcatcccattcctgccttttatatgccggatcgctcagacggtagcttttcgtcagccggtgcatgttccccgtgtactttccaagctggtaaaacagagttccgttccagtctgattcctccactttgcgtccgggcgctttttcatagactcttaataaaaacgctccgccttttccgtccggcacttcttcgacatctttgccatttaatgaaggaatcggctttgctactgaaagcccttcctttgccagatgatgaagccattccatttctccgagaatatattccggcgttcttctgatcgtatgcgtaatttttaagatatacggttcgttatctttcacaatttcatatacgtagttctctgcgtccgcaataaattgaaacttggtaaatccgtatatttcaccggcttcagccagcaccttatcttcctcaaaaatcgctttaatatctttatgcatgctgattcacccttttcataacatttgtaggcggtgtgtgtactcagcaaatgtcattcatcaacattcctgcccttcttttttcacagcagattcgtaacatccgcttagaaatgatatgtgttttcctgttaattcctaattatacaaatatcttaacatacctcattcctctctccaacgatattcacactaaaaaacccttgctcatacagaaatgaacaagggcatcttggttaatcgtaaatatggacggtcggttctttgtcacccgcattgcggacgatcagcgcttcctgcccgtcagacgaggtaatgttaatttcgacatcaactgagccttttgaataataatccatcagctcacctgttaagtattgggtgaaggcgatgacttcacttttcccgtaaaattgcatcgggatttcaatcttcatttttctcatttcatcgttttcgtacattgccgttccgacaactccggtgtaattcgggaagtagctgtcgatggcgtttttgaagcgtttaaacacttcggaatcatcagggtatttctttgccgtgtctgtatccgccggatagaagacgtacttttctttgacatcatcccagtttgaaatggtggatgagccggccttgacttctgttttcgcaatgtaattccccggtacgattgatgttttcggcgcttgtttataaagggcgacggtaatcggcacatttttcaggttatccattttccgaaggcggttaacgacttcctgtgcgatttcttcgccgtggctgcggatcgttttgtcgctgagctccacttcctgctgcggatcacctgtgttttcgcggtaatagtatacagagttgagagcgagaccgatcatgacaccgccaagctggatggaatttttatcttttcttactaagtaatcctgctcaagcatggacgctaagtaaatcgggctgttttcgtttttctcttttgctgatcccgagcttggcagcaccgggtttaagccgagattctggaaattggcgtctgcctttttcgcctttttcagatcactgccctcttttttgcggtcaagccagctgagaaccgtgtcctcatctaaatactggccttcctgatacaaatagtcatccgtcgggaacgtgtcttgagcgagccgcatcagcccagtctcgaattcatcgatgtccagcctcgtgttcagccggtccgcggtcaggccgcgcgcttttccggccttaaacgggagcaccattttatagtaggaatcagagatattatatttcggtatgatcgctttttcagaagactttgccgttttctgcgtgatctcttcctctttttttcccccgaaactcggcgaacaggccgacagcatgagtactgccgccgttgccgtcgccgccaatgccaacatctttttcaatagaaaacactcctcttatttctttagctctcccaatagctgtgcttcattccatacttcaatgtttaattcctgcgcttttgtcagcttgcttccggccgcttctccggcaatcagcaagtctgtttttttgctgacagatcccgtcagctttccgccgagcgcttcaatctgcgccttggcttcatttctggacagctcttcaagctttccggttaacacgatggttttgccggcaaaataagagtcgctgtcctctgcttttacttttttcgggcctttgtagagtgtgttcacaccgagttcctcaagttcattcaaaagctcaagcatttcctctttgcggaaataggtgataacggcatcggccatcttttcgccgatttcatctaccgcaagcagctcttcttccgtggcttgtttcagattttccaggctttcaaaatgcatggccagtgttttggccgcttttgagccgataaaacggatgccgagaccgaacagcaggcgttccagcgaattctctttcgacttttggatggagctgatcagattgtcagttgatttttcccccatccgctcaagccggatgacctgttctttcgtcagcttatacaaatcagcgacattacggacgagatgttcacggaaaagctgtgtgatgacacgttctccgagtccgtcaatattcatcgcgttgcgtgagacaaagtgaatcaggccttctctgatctgcgccggacattccggattgatgcagcgcagcgcgacttccccttcaatgcggacaagttcgctttcgcactcagggcagctggtcggcatattgaattctttttcttccccggtccgctgttcaattaagacattgacgacctcagggatgatgtcgcccgcttttttgacgaccactttatcgagaatgcggatatccttctctttaattaaatcttcgttatgaagggatgctcttgagaccgtcgttcccgcgacttttaccggttccagaacggcggtcggcgtaataacgcccgttcttccaacattcagttcgatatcgagcagttttgtcacgacctcttcagccgggaatttgtaagcaatcgcccagcgcgggctttttgccgtatacccgagttcttcctgctggtcgagcgaatcgactttgatgacgattccgtcaatttcataagggagatcggcccgcttcgcctgcagctcttcgatcatttcaatgacttcatctatcgtgtcgcattttttccgttcctggtttgttttaaaaccgagctcatccagaaaatccaggccctgactctgtgtttccacacccatctcgtcaagctccgctatactgtagacgaagatgtcaagatttcgtttcgctgcaattttcggatcgagctgtctgagtgagcccgcagccgcgttccggggattggcgaacggctcctcttcatgtttcagcctttcctcattgagcgcttcaaatgactgtttcggcatgtacgcctctccgcgcacttctatggaaagattacgtttcattttcagcggaatgttgcggatcgtttttaagttttcggtgatatcttcgcccgtcgttccgtctcctcttgtcgcgcctctgacgaaatagccgtcttcataacggagagaaacagcaagaccgtctattttcagctccacattgtaagcgacgccgtcaccgacagcctgacggacgcggcggtcaaaatcgcggagatcatcatcgttaaatgcgttgccgagactgagcatcggcgtgccgtgctgcaccttttgaaaagattcaagcaccgctcccccgacccgctgtgtgggcgaatcaggcgttctgagttccgggtgctcttcctctatggcaatcagctcctgcatcagtctgtcgtactcggaatccggcacgctcggttcatctaaggtgtaatattcataactgtactgatcgatggtgcggcgcaattcttctgcccggtgtttcgctgtttctttgtccatcatgttcttcctttcctcttcaggttactgcttttcaatcggcgcaaaagcggcaagcagacgcttcacgccgactgggctcgggaatgcgatatcaagctcggtgctttcgccttctccttttacgctgacaaccgttccggtgccccattttttatggcccgctttatcgccgaccgcccagctgagcgagtcgccgcctgttttgttcgcataggaaacgggacgggatacgggcccgcgtttcggctgcacttttcttcccggctgcatgcgaggtgttttcttctcatttaggttctccaataaatcgccaggtatttccctgataaagcgggattccggattcatattggtgcggccgaataaggttcgcattttggcattcgttaaatacagttcttcttccgccctcgtaatgcctacatatgcgagcctgcgttcttcttccatctcggcttcttccatcagggagcggctgtgcgggaacacgccttcttccatgcccattaagaacacgactggaaattcaagccccttagcggcgtgcagtgtcattaaagtgacggcatcctttccgcctgcttcttcttccttctggtcgagctggtcaatatccgcgatcagcgccagatcggtcagaaacgcgacgagagacttgtcttcgcttttttgttcgaagtttttcgtcacggaaagaaactcgtcgatattttcaaggcggctttgggcttcgattgatttttcggccttcagcatttctctgtattccgttttttcgagaatttcttccgtgagttccgtaatggacaggtaatcctgcatgttcgtcagattttcaatcatcgcgccaaagccgtcaagcgcgtttgccgctttcgcgctgacaccgatgaaatcaacctgtttgatcgcctggaacattgacattccgttcatcgccgcatatgaagcgattttttctagcgaagtggcgccgacgccacgcttcggcacattgacgatccgcgtaaaactgatgtcgtcgtccgggtttgacacaaggcgcaggtatgcaagaatgtctttaatttctttcctgtcgtagaacttggttccgccgacgatattgtagttcagaccggattttaaaagggtttcctcgatgacgcgcgactgggcgtttgtccggtataaaatcgcgatatcggaaagcttccgccggcccgagctgtgcagctcataaattttgcccgcgacgaattggccttcgccgaattcattgtcgccgctgtaataagaaagcttgatgccttcgtcattttccgtccacaggtttttcggcttgcggtttgagttgtttttgatcacttcgttagccgcctgcagaatccgctttgttgagcggtagttttgctcgagcagaatcacgtttgcgctcgggtaatctttttcaaaggaaaggatattcgcgatatccgccccgcgccatctgtaaatggactggtcggagtcaccgacgacgcagatattttcaagacgggccgcaagctgcttcacaaggaggtattgcgccctgttcgtatcctgatactcgtctacgtgaatgtactggaatttgcgctgataaaactcaagcacttccggcacacgctcaaaaagcttaatcgtcgtcatgattaaatcatcaaaatcgagcgattggtttttcagcagttttttctgataatcggtatacacgtcactcgtgacctgatcgtagtagccgccggccgtttttgcgaattcctcaggttcgatcagctcgtttttggcgctgctgatggagcctaaaatacttctcggatcaaactttttcggatcgatattccgctctttcaaaatccctttaataacggaaagctgatcagccgtatcaagaatggagaagtttcggttgatgccgattctgtcaatatccctgcgcagaatccgcacgcacatgctgtggaaggtggaaatccagatttcatccgcgccgggtccgagaatgctctccacccgctccttcatttctctggcggctttatttgtaaaggtaatcgccagaatgttccatggcgccacgtgtttttccgccattaagtatgcgattctgtgcgtcagcacacgtgtttttccgcttcccgcgcccgccatcagaagcagcggaccgtccgtcgtcttgaccgcttcctgctgaacgggatttaatccgcttaataattgattgctaatgtaattcatatccgttcaccgcctatcaaacatatgttctatcataaatcaatttcgtccgcttggctactttgtctttacagccgccaccgttttgagcgcctgatcaaaatcttcatatacggcatttccgacaacgatgacatcggcatgacggccgaaccgttccgccgtttccgcgtctttaatgccgcctccgtaaaacaggacggacttgtccagcacagccttcgttttctccaccgtttctatgtccgccagcatcccgctgtattccagataaaaaatcgggagatgaagcaaatgttccgcgacccgcgcataggcgagaatatcttctgtttctatatgtgtatccgcctccgtcaaagcggccgccttacaatcagggttgacgatgcagtagccctccgtcacgatttcctccattgacatgagctctccgtattctttcatcgcctgatgatgcatgccgacaatccagtccgcctttttgctgttgagcacactcggaatgaaataaagatcaaacccgggcacaatggaatcaatcgtcgacacctcaagtacgcacggcactaaaaaccgccgcacctttgacatcagtctcagcacattgtcctcggtgatattgtcgcttcctccgatcacaatggcgtcagtccctgattcacaaagccgttccagctgttcatccggtaaatctttattcggatcgagtttaaaaacatgcttccactcgttaacatcgtacatgcgttttcgttcctccattcgtttcttgccatttaaacattataacaaattcgtttggcccggaaaaacggaaaaagacgtcattcacctgattcacaaaaaaagattgcgctccgccggacgggaaacggctatgtttgaaaacagacaaaatgtggaatgtcaaagagaaaaaaggcaaggagtctgatctcaatggaacaagccattatcgtactgatttgtatattgatttttattattttagttcccgccgcattgtttctctggatttacataagagacgaaaagcaggaagaacattcagtgctgcgcaattatcccgcagcgggaaaactgcgctatatatttgaaaaaatcggacctgagctgcggcagtatttattcagcaatgataacgaagaacagccgttttcccggagagaatatgaacagacggtcatgtcgggaaagtataaaagcagaatgatgggcttcggctcagaacgggatttcgatcagccgggctattatatccgtaacgccctcttcccgaaacaaagggaggagctgcgcacagatcagacgccgaagatcgacacgatggtatacaagattgacaaagacaacctgctgaaacgcagcgaacaccgcgaaaaagcaaaagcggacccttattacctgcatccggacgatgtgcaagtgatcggccgcgacacatgcaagaaaccgttttatgtaaaagggttaatcggacaatcagcgatgagctacggctcacttggcgaccgggcaatcaccgccctgtcaaaagggctgcaccaggccggcggcacatggatgaatacaggcgaaggcggcctgtctgagtatcacttgaaaggcggcgcggatattatctgccaaatcggccccgggctgttcggcgtgcgcactgaagatggagaattttcatgggaagaatttaagaaaaaaagccgcctcgagcagattaaagcctttgaattaaagcttgcgcaaggggcgaaagctagaggcggtcatattgacggttcaaaggtgaccgaagaaattgccgccatcagaaatgtgcagcccggacaatccattgacagtccaaaccgcttcaacgagttctcaaatgttccggacatgcttgatttcattgagaaattaagaactgtcggtgaaaaaccggtcggcatcaaaattgtcccgggcagccgcaaagaccttgaagaccttatttcctgtatgagttcatcaggcaaacttcccgactttattacgattgacggcagtgaagggggaacgggagcttctttccatgagctggcggattccgtcggcctgccgattctgaccggcctccccttgttgacggccttttgaagacatacggtataagagataggctgaaaattttcgcatccggaaagctgctcactcccgataagattgccgttgccctcgcgttaggcgcggattttgtcaatattgcccggggaatgatgttttcagtcggctgtatccgcgctcaagtatgccacaccaatcattgtcctgtcggagtggcgacaaccgatccaaaacttcagcgcgcgctcagtatcgaggataaacagcatcgcgtctgcaactacgtgctctcgttgcgtgaagggctgtttcatcttgccgcggcggcgggtatcagctcgccgattcatttctcagctgaacacatcgtataccgggaggaagacggaagcctgagggaacttcccggccttttgaatcagcacgcataaaaaaaccgcctgccgtcatcggcagagcggttttttacgtagctgaggaggattctcctttgtttacgcggtcaagcgccatttcataggcgtcgttcccgtaatttaagcagcgcttcacccgggaaatcgtcgctgtggaagcacccgtttcgctttcaattttgtgatacgtatttccttcgcggagcattctcgccacttccaaacgctgcgccagcgattggatttcattaatcgtacaaagatcgtcaaagaaacgatagcattcctccagatctttcagcgataaaatagataaaaataactggtccagttcttttccgcgtaatttatcgatttgcatcgtcaaacaccttctcctttactaatggaagctgcatcgagatcaggcacgatattaatccatgtctttcctggcacaaacggaagaatctcaccgccttttacgggcagaatacggccgtctttatattcccagtctgactccataacatcgccgtgctgaagcaggaggcccttcccccctgactgaatatcgatggcccgccttccatctttgtctgtcatgcgatggccggcttcaacaataaaaatgttgtgcatggctaaaggctttccggtctcccggtctgtcgctttcacaccatcagagcttcttgtataagcatcagcttttttatcataatcgtattcgacaagatttgtaacgttttgtgttccataatctatccgaatattgtaggtttcgtttccgggttttgcatctgatgtctgaaatgggagcggttctgtttttccgttcagcttgtatcctttttgttccgccgccttcctgatattgtcatacgacgtgtaggaattgtggggcggcttgctgaaatcggctctccaaaacaggctgccgtcaaaatccaaaccgtttatataatcgtaagttccggactccagctgctttttagcgccgggactccagccatgatggacaaatatgctgttaaacccgctgctgagcgtgacaaaatattccctcgcgctccgcacaggcccgaccgtttccggcatctcactttgaaaaatcgcgagaaaccgcgtaatccggccctccgcgagcgcttcgatgacaacatccgcctttgacagcccggattggggcctcgccttcggatgattgttcactgcgactgcaatcggacggcgttctgcaagcttctgctcagttttcagccccgttaaaggagcttccgcttctttcggctgcacctgatcggcattgttctgccggcaggcggcaagcagcaaaaacgcaaaacaaagcatacaaacggttttccatcttttcatatgtcggctccctgcttttatattttaacgcattatcgatggaaagagtacagtttttttcatcacgtcgaatattcctctcggcgtaatgcggatataaggcaggtgtgtgctctgcaaaaagagcagcgtatagatcggatcgcagaatcggtagccccgctcctccagcagcgtcctcagtttttgctctttctcaagcacttcttcataattctccgcggatgcagaaccgtttaaagcgaggggaatctcatgaagaaccttcccgttttcggcaagcacgattccgccgccgatttctttcatccgtgagaaagcgagcaggatatcttctttattttttccggcagcgataatatctccggttgtcgtgtaggaactgacaaagccctgcacccgatcggcaaaacctttcagcattgtattgacccgccattttccatgcttatcgagaagcgtgagatagcattcatcatgatcaaaagaaagctggtcaacagaattatcaatcgcaatcatatacggctccataatgacggcgttgcgcattatcacacccatcggcattgaaaactgtaaatcatccatcgtcatatcatatgaaagctcaagagggacaagaccgccctttttccaatccgtttctgtaaacgcattcatatttcggccgtcttccctcagcaggatgcctttggagatcaccgtgaccgggtccggattcatcgggtcatcgagaatgttcaatgaagcaagccggcccggaccgatcacaccgagaaagtcatccatctgataatatttcgcgatattaaaggaggccatattgtaggcgtcaatcgccggaaccccttcctccaaagcgattttgattaattcattcgtcatgccgcctttataaaaatgcggcgtcgctccatccgtcgtgtaaaagaaatgatcataatgccggaagcctttttgatggagatcctgcaaaatcgttctcaaatcagggcggatggatgaatgtctgagcgaaacatagtaacccaattcaagccgtctcatcacctcgtcgccattcatcgcctcgtggtcagaatcagccccgaacagtttcatcttcgtcagtgttttttcagaagctccgggaaaatgcccttctatccgcttgcgcagtttctttgtcgcctgcatgcaatgaagcatcaagtcatcgccgtccatgaggcgcggccatccggtcaattctccgccttgaatgacatccggatgctcaatccattgcttgcggacatcaaaagaaaggagctggtcctcattcagcacttcagtctgcagatcatatctggaccaccagaaatattgcaccggctgtttttttagttcttccaatatagtaagcgctttctttttaccgctgtgcaaaagaaaaaacaagttatcattaacaaacgtcgttgttccgaattgagacacatattcggcgagcgtttggggattatatatttgaaaaggatgtgtatgcggttcaatgtaacctggcacaatgtattttccttcacaatttatggtatgaatgtgctctgctgcatcaggaagctcatgaccaacatatacaattcggtctccgtaaatccagacgttctttttcagccattgttttaaaaaaggatttaatacgagagcatcccgtaaaagtagcgttggaagcagctttgagtctacaacatccgcctgtgatctgatgtctttatttttccagttaaaggtacgttcggacattcacatactctccttcgcttatattagacccatcgtatcacatccgcacaattatcgcacggctaaaacgttacaaattattgaagatgaatgaaaaactttttctaagggagctgaaatgatgaaaccgaatatcagtttattaaacgccgttatgcgcatcacttgcggcctcaccattttgtctgccgcttcagcaaaatacacgagaaaaccttggtgcaagatgcatctcttctgtatgatgatgggcgcgatgaaagcggcgtccggcatcctccgcttctgtccggtgacatatatgttccaagccggaatgaatcaggatgacagccatcagcaagaaaaataacaagccgtttcggcttgttatttttttctcctgtcccgcgagtatgagaagaatctgccggcgatcccggcatcacaaaagccgggacagaattcaagactgcatgacaatcttagtcgtcattcagaagaaaacccgcatcttttaagacgcgggggtttcctctttatcgctgcgatgctttcagcgcacgggcgccgatatcgcttctgtaaaacagtccgggttttgtcagccccgaaacggcgctgtacactttatccctcgccgcttcaaatgtctcagcaaatgccgtgacattggcgacccggccgccgttcgtaacaaattgtccgccgtcttttttcgttccggcatgaaaaacggcgatcccgtcttcagcggacgtcaaactgccgatcggcgtccctttcgcatagccttccggatagccttcagaagccaggacaacgctgaccgcggccgtatccttccatcttaggtcaacatctttctcatgcagaagatctaagagcacctgaatgaggtccgattccattctcggcacgacggcctgtgtttccggatctccgaagcgcgcgttgaattcaatgacctttgatccgtcttccgtcagaatcagccccgcgtacagcacgcccgtgaaggagcgcccctctttcaccattgcttttgccgccggcttcacaatcgtttcgactgcgcttctgacgatatcatcggaaatgtgcggcaccggtgagtaggctcccattccgcccgtattcggccctttgtctccatcgaaggcgcgtttatgatcttgagcgatgaccatcggatagacggtctccccttttacaaacgccattaaagaaaattcttcgccggcgagaaactcttcaatgacaacagatgcgctcgcctccccgaatttctcatcctcaagaaaatcgtgcaggcattcaatcgcttcttcttccgtcatcgcgactgtgacaccttttccggcggcaagcccgtccgctttaatgacaatcggcgcgcctttttgctgtacatatgctttcgcctcttcaaatgaagtaaacgtctcgtactccgccgtcggaatgccgtattttttcattaaatccttggcaaactgtttgcttccttcaataatagccgctttttcagacggtccgaaaacaagcagtccggctttttcaaactcgtcggctatcccttcaatcagaggaacttcggggccgataatcgtcaggccgacatgatgttctttcgcaaacgcaatgagtgcggcatgatcgctttctccaatgttgaccagcgtcgcgcagtctgtcataccgtcatttccgggcgcggcgtacaccgtgtcaacaagcgggctttgcgccgctttccaagccaatgtatgctctctgccgccttttccgataatcaatacattcacgcttcgttccccccttaatgtttgaaatgtctgatgccggtgaataccatggcgattccgtattcatccgctttcttaatcgaatcttcatcgcggaccgatccgccgggctggataatcgccgtgacaccggcttttgcggcttcttcgactgtatccggcatcgggaaaaacgcgtctgatccgagcgcgctgccttttgctttttctccggcctgctcaatggcgattttggctgaaccgacgcgattcatctgtcctgcgcccacaccgaccgtcatatggtcttttgcaaggacgatcgcgttggatttcacatgtttgacgactttccaggccagcttcaaatcttcccattcctgctcgctcggctctctttttgtcgggatggtgatgtcggcgtcatcaaatccatggacgtctaaatcttgaatcaaaagaccgccctgtacggaagtcagctgtttttctttctttcctgatgcggtcacgtcaagcgtgagcagacgaaggtttttcttcgccgtcagcacgttcagcgcttcttcactgaaagaaggggcgataatgatttctaaaaagatgccgtgaagggcttcagccgttgcctgatcaacttcacggttcagcgcgatgatgccgccgaaaatggaggttttatcagcttcatacgctttattgaatgcttcctcaattgaagctcccgtaccgactccgcatggattcatatgtttaacggcaacagctgcgggttctgtaaattcccggacgatttgaacagccgcatccgcgtccttaatattgttataagaaagctctttgccgtgaagctgttttgccgctgcgatggaaccggagacaggaagtgcgctttggtagaaaaccgcctcttggtgagggttttcaccgtagcggagcgactgttttttctcaaaagtaacagtgaattgctcagggtctttctcaccggcctcgcgtgttaagtaatcagcgattaatgcgtcgtatgccgcggtatggcggaatactttggccgcaagctcgcgttttcttttgagcgaaacgccgccgtgttctttcatctcattgagcacggagctgtaatcggccggatctgtgatgaccgtcacatcctgatggtttttcgatgcggcgcgcagcatgccgggaccgccgatatcaatgttttctatcgcttcatcgtatgttacgtcttcttttgaaatcgtttctttaaacggataaaggttgacgaccacaaggtcaatcggtgcaatgccgtgttcattgatctgcgccatatgctctttattgtctcttacggcaagcagaccgccgtgaatattaggatggagtgtttttaaccgtccgtccataatttcaggaaatccggtcacttctgaaatgccgatgacatccacaccgttttcctgaagaagtttttttgttcctccggtcgaaatgacttcgacgccgagctctgtcagttcctttacgaaaggtacgagatttgttttatcagaaacactgattagtgcgcgtttgattgtcatgccttttcacctctgttatttagtcccagcagccgtttcacaacgctcggataccatttgtgctcaagctcgtgtattgtatgctctatgtcttcaagcgtatcgttttcctgtatttcgaatgctttttgcgcgataatcggtccggtgtccatgccttcgtcgacgtaatgaacggtaatgcccgccactttcacaccggcccgatacgcctgtccgacagcgtcaatcccagggaatgccggaagaagcgagggatgtatattaataatgcgtcctccgtatgcttcaagcagcgtatctccaatcagtctcatatagccggcgagaacgattaattccgccccgtgcaggcgcagctgttcaataatggcccgttcaaaggccgctttgttttcaaaagatgacggttcaaaggcgaatgacgggatatgtaaagcctccgccctttccgccgcctttgcctgaggcttatccgtcacgagaagcgagagctccgcatcccacttctcttctctcatgcgtttggcaatggcctcgaagttcgatccgtttcctgaagcaaataccgcaaactttttcatgaaagagccgcaccgccgaaagaaatgccttcgccccgcttgacccggccgatcagataagccttctcgccctgagcttcaagcgtgccgatgacgtctgtcaggttttcttctttaacggcaaggacaaaaccgatgcccatattaaagacattgaacatttcttcttctttcagcttgccgtgctcctgcagaaacggaaaaatcggcgggatcggccatgatccgtgatcaatttccgcgctcaatccgtccggcagcatccgcgggatattctcgatgaatcctccgcctgtcacatgcgccatgccgtccaccttaccgcttttcaccgccttgagcaccggcttcacatatattctcgtcggttccagcaattcttcgccgagaggacgcgcaaacggttcatagacagtatccaaatcaagtccgccgtcatcaagaagcacttttctcaccagggaaaatccgttgctgtgaaggccgcttgaagtaagtccgattaagagatgcccctcttcgatatgttcaccggtgacgatttcgtctttttccgcgacgccgactgaaaagcccgcaatatcgtattcatcagacgtatacagccccggcatttccgccgtctcaccgccgataagcgctgatcctgactgctcgcatccgtccgccacaccctgaacgatctgctcaattttcaccggatcagccttgccgaccgccaaataatcaaggaaaaacagcggctccgctccctgggcaagcacatcgtttacacacatcgcgaccgcatcgacgccgatcgtgtcatgcttatccattgaaaatgcgagtttcagtttggtgccgacaccgtctgttccggaaattaaaacaggcttttgatacggaagctctgacagatcaaacattccgccaaaaccgcccaggcttcccataacgccgagccttttcgtgcgctccacgtgttttttcattcgtttgacggcttcgtatccggcttcgatgtcaactccggcatttttataagcatcagacatccctatcactccttgtcaattcgtttctcctaaaaaggcagaaagagaaaggcagcctgaattcccgctgcctttatgtcattttcacattttattttgtcagcaccgcttcttttacgtgaggaagcactgtatcctgataaatttccgtcggatatttgcccgtaaaacaagcgaggcattgtccgcaattggtgtcttcaaattttcggccgactccttttaacaatccgtctacacttaagaaagaaagcgtgtcggcaccgatgatctgacggatttcttccacggaatgagaagaagcgatcagctcctcatgggttgatgtgtcgataccgtagaagcacggatgagcgatcggcggtgaactgatcttgacgtgcacctctgtcgcccccgcttctctgagcattgtgacaatccggcggcttgtcgtcccgcgcacgatggaatcatcaaccatgacgacccgttttccttcgacaacaccgcggacggcggacagcttcattctgacgccttgctcacggagagcctgtgacggctggataaacgttctgccgacataacggtttttaatgagaccgagttcatacgggatgcccgtcgcctcggcatagccgatggccgcagaaatactggaatcaggcacgcctgtgacgacatccgcttcaaccgcggactcccgggcaagcattttcccgaggtttttccgggcgctgtgcacgttaatgccgtcgatattgctgtcaggtcttgagaaataaatgtactccatgctgcagatggaacggttgatattcatggaaaaacgctctgatttcaagccttcatcgttgatgatcagcatttcgcccggctctacctcacgaaggtacgttgcgccgacaacatcaaatgcgcacgtttctgaagcgaccacataagcatcgcccatgatgccgattgacagcggtctgagtccgttcgggtcaagcgctacgatcatctctgtttcagtcatgattaaaaaggcataagcgcctttcagcatagatagcgaatttttgatttgatccttcagcgaaaagtgtccgctgcgtttaatcagatgagccagcacttccgtatcggaggaagtctgaaaaatgctcccttggttttcaagctgctgcttcagctgtgtggcgttgaccaggtttccgttatgggcgagcgcgaggctgccgttgttttgcgaacggaacaggagcggctgaacattttcatatccgcctcctccagccgttgcgtaacgaacatgcccgatcgcgccttttccctttactttgctgagctcgccgttttgaaatacttcagtgatcagcccttggcctttgtgcgccgtcagtttttcgccgtcagtcgcgacaattcccgcgccttcctgtcctctgtgctggaggctgtggagaccgtaatacgtaatttgcggggcttcttcatgtccccagatgccaaacacaccgcattcttcattcaggcctttgatttcagcaagcatggaatagctcctttccacgcgcgctcaagttctttcgtttgcgcgtgaaccaattgttgtccgtcctggttttgaatcgccagaagtccgtcagccgttacctcaccgatatgaaccgcatcagccgcagccgcttcaaacgccgcttggtgttcttttttgaccgaaacgacgaagcgggattgagattcagagaataataatgccgcttccccttcaacagtcacgttggcgccaaggttttccgtcgtcatgacactttctgcaatcgctacgcctaagccgccttcagatacgtcatgcgcggattgaacgaagccttttttaatcgcgtcaagcaatgctttttggcgtgacagctctatatcaagatcgatttgcggcgctttgccgtaaatgcggccttctgtcattttttgcagttcgcttccggcaaactcaggttttgtttcgccgatcacgtatacaagatcccccgcttgtttgaaatgctgtgtcgtaatatgagcggtatcttcaattaagccgaccatgccgataacaggcgtcgggtagatagccgttccgttcgattcattataaagtgatacgttaccgccgatgacgggtgtgctgagaacattgcacgcctcgctgatgccgtcggccgctttttcgatctgccagaaaatttcaggtttttccgggtttccgaaattcagattatccgtgaccgcaagcggttcggcgccggagcatacgatgttgcgcgccgcttcggcaacggcgatttttccgccttcttctggatcaagatataaataacgggcgttgcaatccgtcgtcatcgccagcgcttttttcgtgccgcggattctgagcactcccgcgtcagagcccggagcgaccaccgtatttgtgcgcaccatgtagtcatattgatcatacacccactctttgctggcaattgtcggctgctgcagcagggcaaaaagcgtctctgtcccatcttttacttcaggcgcgggaacttctgtttcctgaaactcgcggtagtacgcgggttctgctgacggtttgtggtatacaggcgcttcttccgccagtgcgtcgaccggaagttcgcaaacaacctctccgttatggcggaggcggagcattttatcatccgtcacatgacctacggaaaccgcttcaaggtcatatttatcaaaaatatcgacaatttcctgttcacgtccgcgttcaatgacgagaagcatgcgttcctgagactcggaaagcatcatttcgtaagcggtcatacccgtttcccgctgcggaatgagatcaaggttcatttcaatgccggagccggctttgcttgccatttcagcactcgaacttgtcagaccggccgcccccatatcctgaatgccgactaaggcgtcgcattggatgacttcaaggcatgcttccaggagaagtttttccatgaaaggatcgccgacctgcaccgcggaacgtttttcttcagatgaatctgacatttcttctgatgcgaaagtagcgccgtgtatgccgtcgcggcccgttttagcgccgacgtacatgaccgtgttgccgacacctttcgcctggccttttttaatatctttatgatcaatcaagccgacgcacattgcattgacaagcggattgccctcatagcttgcgtcaaactgcacttctccgccgaccgtcgggatgccgatacagtttccgtatcccgcgattcccgccactacttcttcaaacaagtacttcacacgaggtgaagtgagttcaccaaatcgaagagagtttaatacagctatcggacgggcgcccattgagaaaacgtcacggataatgccgcccactcccgtcgcagcaccttggtatggctcaagcgctgacgggtggttatgagattcaattttgaacacgaccgcctgattgtcaccgatgtcaacgattcccgcgccttctccgggaccctgcagcacgcgttcgccgctagtcgggaatttgcgtaaaaccggttttgagtttttatagctgcagtgctctgaccacatcacggaaaaaatcccgatttccgtgtagttcggcaatcttccgataatagattcaatgagtgcgaactcgtcatcactgacacccatttgctgatagagtttctcttcttttatttgttctttacttggttcaagcagtagcgacatgagtttccctccaatttttcacgatagaccggaacaatgtaagaccgtctgcgctgccgagcagttcatcgactgcgcgctcagggtgaggcatcatgcctaatacgttgcctttctcattcacgacgccggcaatgccgctgacgcttccgttaatatcgccgccgtatgtgaagacgatttgattgttttcttttaatctttcaagcgtttcgtcatcacagtagaaattgccttcgccgtgggcaaccggaatcgtaatcgattgtcctttttcataggaagatgtgaataacgtatcgccgttctgtacgattaattcaaccgggcggcagatgaactttaaatctttgttgcgtctcatggcgccgggcagaagtccgagctcctgcagaatctggaatccgttgcagacgccgagaaccggttttccttcggcagccgcttttttcacggccggcatgatgtttgcgaatctggcgatggcgccgcatctcaagtagtcgccgtatgaaaacccgccggggatgagcacgccgtcaaatccgtcaaggcttgtttcctcgtgccagacatactcgacttcttcgccgagttcgtcctttacggcgtgaaacatatcaatatcacagttggagccgggtaacacaatcaccgcaaatttcactgtgcgacaacctcctcaacttcatatcggtagtcttcaatgactgtattggcaaggagcttttcacacatttctttcacgagcgcgtcaagatcgcggtcagatttttcgatcgtcagctccatgtattttccgatgcgcacatcctgcacttcattgtaggtcatgctgtgcaatgcatgctgcactgcgcttccttgaggatcgagcacactttcttttaagctgacataaactttcactttatacattatgaaatgcctcccagtcttttgaaaatctcttcgtatgcgtcggttaagctccccaggttccgtctgaacaaatctttatcgagcttttcgtttgtgtctttgtcccacagacggcacgtgtcaggagaaatttcatccgctaaaagcacccgtccctctgcgtctaagccgaattccagcttaaaatctattaatctgaccccgcagtcttcaaaaatatgctgaagttcttgattcacctggtttgtaatcgatttgatcgtttcgacatgctcaggagccgccgcttttaagagccggatatgatcttctgtgatgagcggatcgccgagtgcgtcatccttgtagtaaaattcgataatcggctgcgggagctctgttccttccgggatgccgagacgtttcgacatgcttccggcggcaatgtttctgaccacgacttcaagcggaatgatgctcacttttttgatgagctgctctgattctgaaacacgctccacaaagtggttgtcaattcctttggcgtgcagatgtttgaaaatcaggcttgaaatttcattgttcagacggccctttccgctgatctccgcttttttctcaccgttaaaggctgttgcggaatccttgtagaccacgcggagaatctgttcgtcttcagtttgataaattcgcttcgcttttccttcataaagaagattattgttcacaatattcacggaaggcctcctaacccgaatgttgggaatattcaatctacggcggctgaagaagccgcctccggctggcttcttctataaacctaaacgctcaaagatcaagtcgacgtttttcagatgataattgtagtcaaagcaatcggcaatctgttccggtgtgaggcgggacgtgattttttcctccgcttcgacaagctggcggaacggcacttgtttttcccacgcttccatcgctttcggctgaaccgtgtcatatgcttcttcacgaggcagacccgtgtcgattaaagcaagcagcacgcgctgagaatagattaaaccgagtgtgcggtccatgttgcgtttcatattttccgggaataccgttaagtttttgacgatgttgctgaatcggttcagcatgtaattcagcgcgattgtcgcgtcaggaagaatgatgcgctcagctgatgaatgagaaatatcacgctcatgccataacggtacattttcgtatgccgtcagcatgtacccgcggatcacgcgcgccatgcccgtcatattttccgacccgatcggattccgtttatgaggcatagccgatgagcctttttgtcctttagcaaaaaactcttccacttcacgtgtttcactcttttggagaccgcggatttccactgcgaatttttcaatgctcgtcgcgatcaaagccagtgccgccatgtaatccgcatgacggtcgcgctgtaatgtctgagtggaaatcggcgccgctttcagcccgagtttttcacagacatactgctctacgaacggatcaatatttgcatatgtgccgaccgcgccggaaagcttgccgacttcgatcccttcttttgcctgcttgaaacgttcaaggttgcgtttcatttcttcgtgccaaagcgcgagcttcaggccgaaagtcgtcggttccgcgtgtacgccgtgcgtgcggcccatcatgaccgtgtatttatgttctttcgctttttcttttataatgtcaacaaatctctcaatgtccttgagcaagatctcattcgcctgttttaatagataggaaagagcggtatccacgacatctgttgacgtcaggccgtagtggacccattttctttcttcgcctaatgattctgaaaccgcgcgggtaaatgcaacgacgtcatggcgcgtatcctgctcgatttccaaaatccggttgatgtcaaaagacgcgttttcgcgcatgaccttgacgtcttctttcggaatgacgccaagctcagcccaggcttcacaggctaaaatctcgacttccagccatgcctggtatctgttttcgtccgtccagatcgcggacatttcaggtcttgaataacgttcgatcattatgctcgtcctccgtctcttttcatccatatgttcgtgatgtcctgaatccatgtttcatcaggcttccgcaaaaatgtcatatgccccattttgcgcccttttttaatctcatgttttccgtacaggtacagtttggcttcttttaaaagctccgtatgctcctccgcaagcttcacttcctcaccgagcagattcaccatcattcccggtttgagaagatcggttctgccgagaggaagtccgcagaccgctctgatgtgctgttcgaattggctcgtttcacaaaggtcgagcgtataatgcccggagttgtgaggacgcggcgccagttcattgatcaaaaggtctccgtcttctgtgacgaacatttccaccgcaagcggcccgacaagctccaatttctccgcgagctggacggcaagcgcctctgcccgcttttgaaccgtttcctccgctctcgcgggcacgatgctttggaacagaatattatttttgtggatattttcagcagccggaaaggttgaaatctcaccgtgcaccgatctcgtcacgataacggaaagctccatccggaacgatacccagctttccagtatgcacgtgccgttttctagcagcgcggccgcttcgtctgtctgtccttcttccttaatgacaaattggcctttgccgtcatatccgccgcggcatgttttcagcaccgccgggagccccagtgcctgaacagcttcctcaagctcccgtccgctgtttacgatccgataaggagcgacttgacagcctgctgactggatcgcctttttttccgtttccctgttttgggtgataagcagcagctcgcttccctggggaagatatgcatgttctttgagccagttgagcgcctcgtaatcgatattttcaaattcgtacgtaatgatgtcactgactccggccaatttttgaatcgcttcacggtcattgtactgggcggtaatctcaatatcggcgatctgtccgcatggcgagtctttcacgggatcgacgactgcgactttatagcccatctgttttgcggcgacagccatcatttttccgagctgtccgcctccgataatgccgatgacggcgccgggataaatcgtttttttatcagacaagctgatcactgctttccagcaccgtttgttttgtcgcatttcttctcgcctctagtttatccgcaatgtcaccgtcaaatgccgacaaaatctgcgcggctaacagacccgcgttcactgcgcccgcttttccgatcgccgttgtcgcgaccggcacgccgccgggcatctgtacgatagacagaagagaatcaagcccgttaagcgattttgtctgaaccggtacgccgatcaccggcagtgtcgttttggccgccgtcatacccggcagatgcgccgctccaccggctccggcaataatgacttttaagcctctgtctctggcgctttctgcatattcaaacatcaaatcaggcgtccgatgcgcggatactacctgtttttcataaggaatgtgaagttcgtcaagtatgtcgcatgcatgtttcattgtctcccaatcggaggtgcttcccatgatgattcctgctagcggctgcattctgttcccaccttctcatgctttgtttttcagaaaaaaaagcccggcttatattgcaactatgaggaagcaatacaaaccgggcatggcgcgcgtatcgtcagtcgttcgcttctgcgatatccatgtcagctgtttatcactttcctgcatagtccggccgtttacggcagccgggtagaaacttatgggccatattcccaagattatatgaggtcgtgttttgatttcatgtttatcttaacaacggacttggataatgtcaacgacattatcgaacgatataaaaattctttcttttaatgttcgtgtttagatcaatttcccttcaaatacgatttttttcccgcaaggaacgacttgaattgatccattttctttcttttctgtaaagatcggctcttccatccgccggacgggcatataaccctcttccttcattaaagtgagaatggtgtcaatcgtttcatgttccgttacttcaaaccgtttcttttttggctttgtcattccttaattctcctcttcttcactgctttcacccagaatccgccgtggatcgttttcggctcaaaggcgatgataaacgctttttcatcaagcgttttaatcgtatcatacagctgaagctcatatttgcgcggcgtcagaatctgcatggcggtccggtctccttcaagtccgcccgcaacccagcttgtaacaccgtatcctttttcccggagctgtttcggcaggtccagatcgagctccttcgtaatgacgttgactgttatgtagccgagcgccagtttttcttcaattttcattcccactatgacgccgaggccgtagccgagcgcataggcaatgacgttttgaatttgattcagattgtcgagcacaagactcaggccggtcacatacacaaggatttcaattgtactgatgcctgcggcgaaatagcgctgtccctttaatgtcagaatcatcctgatcgtaaagaaagagacatatataatgttaatgatgagaataatgagaaccatacctatactgttggataaaattgtctgcatcactgattcccctcctctgactttgaaaagccaatctttcaattaaggatagtttaccctcttttcatcattttcaaaagaaaaaaaagcccgccccgcaaggcagactctcaagctcttatcagtgaagctcggcttttttcaatcgtttgacggcttcatattccttctcaagttcactcagcgtgtacccggacagttcctgaacatggtcttgataaaaccctgagcggatcagttttgtcctcaggtgctgttttttccgattaatggcttctcgcaacaacggggccatcttcatcatccctttccgaatcataaagagtagtgccgctttcgaattgctgttgctctcatcatatctcggccgggtcctcaaaacaacacgcttcattagaaaaatttgtaaacattgtgaaagacaaatttcgacttataaaggaatcagcgaagcagtaaagtactcggaaatgagcggccatgtcacagccgtaaaaacgagcatgatgatgaccgccgcggaaatacagtacatcacgtcagccgcaggcttttcagccgatttgtatagaatctgcacaaactgcaccatcgccgaggcggccagaaacaaggtcagcgccgtaaacaccacggtgatgaccggcagattcaatatcgcgaaaatcatccacacgatagagcaggcgacagccggaaccaaaagcgatccgacccccgcggccgcatcccgcatcgtaattttctgcttcatcatataacgtgatacaagccagaccgcgccggccgcagcggcaaaaaagacgagcgtatacacgagaacgacggtaaagccgtcaaaaaacgtatgatgccgctccccgtatccgagaggcctttgctggcttgccctcagctgaaaccaatttccgattgagaaaaagatactgaatacaagcattgaaataagagcatatttaaagcgggaaaagccgtcttccccaacgaccttcaccggtgatgtcaaaatgcgcagcgcgaaacggcaataacgtttgaccgcggcccatgcagaagcgagtttttccgtaaaagccggagccgggcgccgttccttttcttttttcttttgcttttgataacgtcccgcatttctggacattctcgacagcggttcttcatcagttccctgatgctgtttttcttcttccaacgtttcttttctttcttccgtcatgtcagcaactcctatcaaaaaaatacggcggaatttgtttagcaagaaaataaaacacttatataaggtaccgaagcggccttaaacagtcaagcggttttcttcacccggacacccacatgacgttttatattatgtattggttttacggaataggacaaaaacaaaaaaccggctttccccagccggtttttccgttatttcaagaagatgaaatacaggataaagatgacgaacagcccgtacataatcgggtgaacgctttttccttttcctttgcagatcattgtaatcgggtagaaaataaaaccgatcgcaatccccgtcgcaatactgtacgtcagcggcatcataatcatcgttaaaaatgccggaacagccacctcgaatttatcccaggcgatcttaccgagcggcgccaccatcagcgcgccgacgataattaaagccggagccgtcacattcgtggtgacaactgacagaagcggcgagaaaaacatcgccagcaaaaagagaatgcccgtcacaacagccgcgaagccggagcgcgcccccgccgcaacgcctgagctggattcaacataagaagtcgttgtagacgtaccgagcacggctccgataacgattgatgttgaatccgccaaaagcgctcttcccgcacgcggaagtttgttttccttcatcagcccggcctgtgtcgctacagctaccagcgtaccggccgtatcgaaaaatccgacgaacaggaaagttaaaatgacaatcagcatttgtacggagaagatatccggaaggtgcatccacgcctgtccgaaagtcggcgcaagactcggcacgctgccgacaatgtgtgtcggaaccggaatcagcccgcagatcataccggcaaccgccgtcaaaagcattccgataaacacgccgccgtttacgcgaagcaccatcagaatgaccgtcacaataacaccgaaaaccgtcagcagcacagggccgctgtgaatattgccgatagacaccaaagtcgatgagttcgcttcaataatgcccgaaccctgcaaaccgacaaatgtgataaacaaaccgatacccgcgccgaccgccaatttcagctcaggcggaatcgcattaatgattttttcccgcaatcccgtcagtgaaagcgccacgaagataattccggaaatcaagacgccggaaagcgcagcctgccatgaaatccccatgccgagtacgacagagaaggcaaaaaacgcatttaatcccatacccggcgcaatcgcgatcggatactttgcaataagccccattaaaatacagccggccgcagatgccaaggctgtagcggtgaacaccgcgccctgatcaatttttaatgcttcgggaaatcctttcacaccgtttaaagacaatgtcagcggattgacgaacagaatgtacgccattgacaaaaaggtcgttaaaccgccgatgatttcattacgatagcttgtccccagctcatcaaactgaaaaaattgcttcaagccaattgcctccttcattctctcccatttattctgcccgttatccgccaaataaaaaacgccccaaatacatttgggacgcttgactacatacgttcagtctgaataaataagaatggattatttatatcaaacgattgagattgatccgtagtcaagccatttacggtagcttggtagaaacttgcgggccatatccccgccattatacgatatctgcatatttgatttctgagtctattgtatcaattcaattttgaaaactcaataaaaaaacgaacaatccagttaaaaaaaattggtttattcgttaattgaccaaaaatggaagacggcaagggccgccttcccggcatcattttccgttcgcaggccgaaccggcaccgcgaatgtgatccccttgtcatccgccagcaagttcataaccgtttgattgacgtacaaagcatatgaatcgaatgagaaatcgcgcaatgaatagtctttatcggatgaatcatctaattcaaaaacggattccatttcaccctttttaagattcgtgactttcgccttattccctttcagataatagcctttttcatactcattaagcgatggccaagttttcatttttttcgtattgccgagaccgattgattcaccgacattcatcagctgatctttatccgctttgctgtaattaattcctgtgaattgataatcgacgatcacccgtctgtcttgctgtttgatctttttgatggtaatgccgacatgatgatgtttcgttttataactgacgggcagttttgttttcagaggcacgatttctcccggctctgattctgtttttatatcacccgttatgaaaagtgttttcgctttcgggtctatcggtttgctgaattgagtttggccgcgtattcttttcccgccgccgggaagattcttcctgccgccaagttcaatattcgacatcgtcatttcataatggtttccagcatcatccgttgcttcgtcaatcgagatggcatcatttttggctgcatcatagaagtcgatagaatacaggagagccgatcccatcgttccgttttccgcccggatatcgaaaaagcggtataatccgtgatttacattcacagctttcgttccttcaagagaaacggacttttgttttttaatagggagtgtaaagcgccagtttccggggatatccttgatttgtgtaatgacaagcggaagcttatcaccgtctttcagctttgagccgtccgtgaacaggcgaagctgccccgcgtaccgcccgtctttcatttttttcatatcactgctgtcataatcctctgctaacatattccgtggatctttataatcgacttgaaaagagatgctctcctcatctgatttcaaattatcaacgataaagttataaacgagctgtccgctgtcgtaatacacacttttcactgtcaccgtgattccgcgtgattccgctttttcgttcagttttgtcaccaaattgcttttaaacagcgcagaacctgccttatcctgaaacagactgtaaatttgtccggcaacaggaatgtttcccatagcggtgttaacggagggcatgaacaagcctgaggacagatacagaataaacagagcagcagcaaccgcgaggccgtttatcacttttcgtccccatctccgtctgacggcgccttcttttccggcacggacagcagcgctgtgtatcacgtttttcaactcagctttcggcacgtcaatgtcctgatacaattgcttcatttgatgcttttccatatgtgtttatcctccttttccagttcctgcttcaatgcttttctcgccctgtagagatgcgtttttacagtgccttccgccataccggtctgttcagcgatcataccaatcgagaaatcttgaaaataataaagctgaatggtcagctgtatatgttcgtcaagcgtttccagagcattccgaagatctatgtattcttcaatattcttattctccgcgcgcgtatcgtgctgcggctcaaacggaatgacgtctccgtgctttttcctcatcgcaaaaatcgtatgaagcagaatccggatcagccacgttttaaaatatttcggctccttcagctgtgcgatatgaagaaaagccttgtaagccgtttcctgaacagcgtccagtgtatcttccttgtgatgcaaataaagataagctgttttatataaagtctcctgatgggttgtgatcagtttttcaaaggctgcggcatcaccttttttcgcctttttgatcaatcgttcttccttcaccttatccacctcctatgctgttagatatgaatcggggcaaaacggtttcaaaaagatgaaaaaaaacgcctcttttttaaaagagacgttttttatcttcatttattcccactcaatcgttgcaggcggcttgctcgtaatgtcatacacgacgcggttgatgtgtttcacttcgttgacgatccgtgttgaaatcacttcaagcacatcccaagggatacgcgcccagtcagatgtcatgccgtcaattgatgttacggcacggataccgattgtgtaatcatacgttctcgcatctcccatgacgccgacgctgcggatgtcaggaagaaccgtgaagtactgccagatgtcgcgctcaaggccgtggttcgccacttcttcacgcagaatcgcgtctgattcacgaacgatttcaagtttttcttccgttacttcaccgagtacgcggatgccaagtccagggcccgggaacggctgacgccatacgatatcatccggaaggccgagctctgtgccaagcgcgcgcacttcgtctttgaaaagggtgttcagcggctcgatcagttcaaactgcatatcttcaggaagtccgccgacattgtgatgcgatttgatcgtttgcgccgttgcagtaccgctctcgataatatccgtgtaaagcgttccttgcgcaaggtaatcgatgcctttcagcttgtccgcttcatcatcaaatacgtaaatgaattcgttgccgatgattttgcgtttttgctcaggatcagaaacacctttcagcttgtttaagaatctgtctttcgcatcaactttaatgacattcatattaaagccttcgctgaacgttttcatgacgccttcagcttcgcctttacgaagcaggccgtgatcgacgaaaatacaagtcagctggtcgccgatcgctttatgaattaaagcagccacaacagaggaatcaacaccgccgcttagcgcgcaaagaacctgcttgtctccgactgtttcgcggattttttgcatttcgatttcgataaagttttccattgaccattcgcctttacattcacaaggcccgaagacaaagtttttcagaaggtcatttccgtattctgaatgacggacttccggatggaactgcacaccgtaccattttttgtcttttttgctcatcgccgagttcgggcagtgatggctcgtcgcgtctaccgtaaatccttccggcacttgtacgactaagtcgccgtggctcatccagacaacttgttcttccggaagatccttgaacaagtctggagttccttgaatctgaatgttcgcttttccgtattcgcgctggcttgccgcctcgactttccctccgaggtaatgagtcatcagctgcatgccgtagcagatgcccaatacaggaatatcgagttcaaagattttttcatcacagcggaaagatccttcatcatatacactgttcggtccgcctgaaaggataattccttttggattcatttctttgatttcctcagctgtcaacgtatggggatgcagctcgctatatacgccaaattcacggatccggcgggtaatcagctggttatactgactgccgaaatcaagaacaagaatcatttcattcactaacttcgtcatggttgtcacctaatctcctctaagtttttgacacagaaaaaacggaggacacacgttcagccctctgtcggcaagacttgtccggaagcccggctttttaacgctcccgggctcccatttaacattcatatattctaacaacaggacgatatgcggtcaagactatcttcttttaattatattttcccacaactgtcccgattcattccaaagctttgcggcattatcgctgcggtataaagcacgctcatagcgcagcgtcagctcggacatgtcgtttgtatggtgcgcctcatcaacccttgcggcaaaatcgcggagcgtttctccgtctcccctgctgaacccttttcgtttcagctggcggagcagcgcggcatatgcgtcgaaaaagacgtcttcatccgttcgccgcttcaatccggctgctgtaacgtgcggaatccagcgcacccggaacagccaggcgagtgccgccgcggctgaaattacgatgacgatggctgcatacggccacaggtgtgccgcggttttgttgcggatcacaggctgcggtgccgcgctgtgatcccgctttttcggtgtttcttctttttccggctttgtttcctgacgctgcttgtcagacggtgaatccgaattccccgctgagcctccgctgtcttttgccgcggtatgattttgctctgacgtaaactccgtcggattggtgaagccttttgtcggctcaaacgtcacccagccctgatcgggaaaatacacttctacccacgaatgggcgttgttgtttgtgacttcataaatgtggccgttatggtcgcctgcccctttatattcaccggatgtatagcccttcacccagcgggcgggaattcccgcagagcggagcagcacggccattgccgatgaaaagttatcacaatatcctcttttcgtttcaaacagaaattgatcgacataatcctgattgtgctccggaaccgcgacatcctgtgtattatacgaaaatgcggaagatccgagataatcctcgatcgccttcgctttatcgaacatattatgatgatcccgcgtcaatctgtccgcaagctgtcgcactcttcccggaaggctgtcggggacctgtaaataccggtcattgaattgattctgctcacggtatcgtttcactttcacttttctgagatcattcagcttaaagacgggcgcctgaaaagtcaccgtgtaccgtcccatattgcggatgttgcccacttgttcactgaccggcgtaatttgctcggtgtttccgttcatttcaagctgaatcgagtgcttcggtttaatattggagacgccgatcggatacatgacgtgattatagagataattctcatcaatggacacctgtgccgtataccgtctcgtctgcacactccggtcaaaccatatatcttccacattgccgccgttcagtttataggacatgccctgatcggtctccacccagcctttccccgtgtatgtatctttcgtttccacccggaagtacgcccgttcttttcccttccatgtaaaaaccggcgtatcatcctcctgaaaaggaccgcccaatgtttcatcatgattgccgtagccgattttactttcggcggcgggcacttctttgtggtttgtgattttttttagaaacggcacgggatccggccagttcgggtctgatttcggagccgccagaccgaacactacggaagcgcagataaacagcatcagcggcagaaaccatttgagtatcaatctttttttaaacgctatgtgttccgtaagccggatgcgctccatatacaaaagccccatcatcaaaaagccgataaagacgatccggatgacggcgtacgcggcatcataaggagtaaacgtatcaagcacggtgatatacgccaccgtcatgataaaaaagaataatattttccgctgatagatcacccagtaatgcagcaaatacacgagcagccataaaagcacaaaaaacagcaacgtgcggaatgacggattcatatcattccatcttccggttccgatgtggcgggcattttgcatcacgtcccgcaaaaaagaaacgagccattccggctgaaaaatagaacctttataaaacaggatgtgaatactgatcaacgtaaacagaatgcaggacggcacggtcacgtaccacctcatccggaagaatgacagcagaaatgccaaaccgataaaaacgatgaaaaaaccggtatgttttgtatccgtaaaattgtgcagcggcctgagccattcccataacaataaaaaagcgagaaaataaaacagcagcagactcagcctgcttccctggttctcgtcatgcggcatggcgcgccacctctctttctaaacaacatgggacacccgtttgtccctgatcatttgcaccttaatatttttctgagcgaagatgagagcgagtttccgttctttctccgaaagcgcggcattcgtttctttcgccaaaaacaccgtcatgtcagcacggccgggctcagcctgtttgagaaggtcttctgtaagactgcccgtcacgacggcaatggaagctttacccagttctttccctaaacgcccgcctgcatcggcttcttccgactctgaagctgatgccaggtaacgcagcatctgtctgaaatgccgctctccctcccggacgggaaatacagtccggtcgctccccaatgaaataaatcctgcgggagagcccttcacaagcgccgtgtaaagcagggatgccgaagctgacaccgcggcttcaaacgaaggggacggcctgcagtccaaaaggagaatcatattcatactctgcaacgggtcaaattccttcgtcatcagctcatttcgacgcgccgatgttttccagtcaagtgcggaaaaccggtcgcccggctgataatttctgacgctcgcagccattgctgtgcggtgtacctgaaacggagcgccggcacccgcaccctcttctccggatgcagcctgcggcttatagtgaacaggcccgtacgccgggaaaaccagaaccgtatccgttacggaaaacgacgccgtcttgtccaaaagcccgagaacatctcccgtccgaactctgatcgtatgtaaatgatgctctccgcgcggcacctgcggcagctcatattgtaacgtcatcttcctttgaaaccacggaaacacaagctgtttcgcactgcgcctctcaccaagcgtttccggcatcacatcttcaatgaccatatatgtcagcggaaacggcaggcgcctcgtcagcctgatggtggcagacagcctgtcgcctgaggttaactgggcggaggacacgtcacgcgtcacctgaaacgcccgcaacgggtacacagcgaccagcccggcgtaaacggtaaacggcaaaaacgcataaaataaaaaccagctcacaaatccgccctgaaacatggcataagaaaagacagccgccgtcagtacggccaacataagcagcttccagccatatagaagccaatgcatcttctttctcattagcggaccgacatcctttgaacgggaactttttccgtttgcatgatgtcttctataaccgcttccggcgtcacatcgttaaatttcgcctcggcggtcaagatcattctgtgcggcagcgtatacggagccaaatactggacgtcatcaggaatgacgtaatcgcggtcatgaagcagcgcgtacgcctgcgcggctttcattattgaaattgaaccgcgcgggctgacgcccagatgtacggacggatgccggcgggtatgctgagtaatgccgacgatatacgctttaactccatcatccacccgcacctgctccagtttttgctggagggtgatgaactgttctttagaaatgacgggctcgattgtttcaagcggattgcgcccttcctgcaaagacagaacccgaagctcctcctcggcagtcgggtagcccatgcgcagcttaaataaaaaccggtcaagctgggcttcgggaagcggatacgttccttcatattcaaccgggttttgtgtggccatgacgaaaaacggctcagccagccgcattgtctttccgtcaatcgtgacattcccttcctccatcgcctcaagcagggaagactgagttttcggagaggttctgttaatttcatcagccagcacgatattccccatgatcggtcccgggcggtattcaaattccattgttttcgtattataaatagagacacccgtcacatctgacggcagaagatccggcgtgaactgaatcctcttaaagtcagctccgatcagcttggccaaagcccggaccatcatcgtttttccgactcccggcacgtcttccagcagcacatgcccttttgcgagaatggcggccagactgagtatggcgatatcccgttttcctatgatgatgttttcaatatgctcaacggctttctccagcagcggatgcagctcttctttataagccattcttctcctcctagtcatctctcaaatttcaattatcgtaacctaactttaccacaaaatataaacagtataaaaaaacgtttccagcgaattgtttccagtccgaaaaaggaaaaaagctccctttagaaaggaagctttatttcagctggagaggctccatatgaacgtgtgaatggtcaatggcatgttcctctttcatcccggcgccttctgctgtacgaatgcgaaaaaaatgtcatattttcttacatcattttcaactgtctgtggcatttatgatagaataatacttgtctgaatattcagcataaacaaaccaaaaggaggcaaagaatgaatcagcctaactctttatctaagggattaaaaacccggcatatgaccatgatttcaattgccggcgtgatcggcgccggattatttgtcggaagcggatcagtcattcattccaccggacccggagcgattgtctcctacgctttagcaggattattagtgatttttattatgagaatgctgggggaaatgtcctccgtcaacccgacaagcggttcgttttcacagtacgcgcatgacgccatcggtccttgggccggttttacgatcggatggctgtattggtttttctgggtcatcgtcattgccattgaagccattgcaggcgccggaatcatacagtactggttcccgggcattccgttatggctgacgagtctgcttctgaccgtgctgttaacactgacgaatatttattcagttaaatcgttcggcgaatttgaatactggctttccttagtgaaggtagcgacgatcgttgtcttcttaatcgcgggatttgcgttcattttcggaatcgttcccggcagcaagccggtcgggctggaaaatttggcgggcagcggcggatttttccctaaaggtccaagttccgttctgctcggcatcgtcgttgtcattttttctttcatgggatctgaaatcgtcgcaatcgcagcgggagaaacgtcaaatccggtcgaatccgtcacaaaggcgacccgctcagtcgtttggcggatcattattttttacgtcggctccattgcggttgtggtcacactgctgccatgggattcagccaatattttggaaagccccttcgttgccgttttgagccatatcggggttcccgcagccgctcaaatcatgaatttcatcgtcctgacagccgttctgtcctgcctgaactccgggctttatacgacgtcacggatgctgtattcactggcagagcgaaatgaagcgccgcggcgttttatgaaactgagtaaaagaggcgtaccggttcaagccattatcgccggcacctttttttcctacattgccgttgttatgaactacttttctccagactccgtatttttgttcctggtcaattcatcaggggcgatcgcactgctcgtctatctcgtcatcgccgtctcacatctgagaatgagaaagaaaatcgaacggacaaaccctgaatctcttaaaatcaaaatgtggttctatccgtacttaacctacctgacgatcatcgccatttgcgccatcttgttatctatgctgtttatcagttcaatgcggtctgaatttctgctgacaggatttattactctgctggtacttgcctcatatgtattccgcaaaaaacaaaaaccgaaagagagcgcttccgaaagccgggttgcgcaataaccgcaaacacccccctcaaaaaagggcgggtgtttttttaaccaacctgttccaggcagcattaactgtagtacaggatttcaataaatgataaggacaggatgaaaaatggcactagaaaaatttgcagatgaactgccgattatcgaaacactccagccgcagaagaaatcagacggcagcacgtattacgaagtcaccatgaaggaatgctttcacaagctgcaccgcgatctcccgccgacccggctttgggggtataacggtttgtttcccggcccgacgatcgacgtgaacaaagatgaaaacgtctatattaaatggatgaatgacctgccggataagcattttctgcccgtggatcataccattcaccattcagaaagcggccatcaggaacccgatgtcaaaaccgtcgtccatttacacggaggagcaacgccgccggacagcgacggctacccagaagcctggttcacaaaggattttaaggaaacgggtccttattttgagaaagaggtataccattatccaaacaaacagcgcggggctctgttatggtatcacgatcacgccatggcgattacgaggctcaatgtgtacgccgggcttgccgggatgtatatcatccgcgagcgaaaagaaaagcagctgaagcttccctccggagagtacgacgtaccgcttatgattttggaccgcacgttaaatgacgacggttccttgtcttatccaagcggacctgctaatccttccgaaacgctgcccgacccttccatcgtcccgtttttttgcggaaataccattctcgtcaatggtaaagcgtggccgtatatggaagttgaaccgcggacatatcgtttccgcatccttaatgcctccaatacgagaacattttctctctcgctcaataacggcgggaagtttatccaaatcggttctgacggcggactgcttccccgctctgtcaaaacacaatctatcagcttagccccggccgagcggtatgatgtgctcatcgatttctccgcctttgacggagaacatatcattttaacgaacggcaccggctgcgggggcgacgtcgatccggatacagacgccaatgtgatgcaattccgcgtcacaaaaccgctgaagggagaagacacaagccggaagcctaaatatctttcaacaatgcctaatgtaacatcaaaaagaatacacaacatcaggacactgaaactcacaaatacgcaagacaaatacggccggcccgttttgacgctgaataacaagcgatggcatgatcctgtgacagaagcgccgaagctcggcgcaacggaaatctggtcgattatcaatccgatggggggaacccatccgatacacctgcaccttgtttccttccaaatccttgaccggcgtccctttgacttagagcgttataacaaattcggcgacattgtgtatacaggccccgccgtcccgcctcctccaagtgaaaaaggctggaaagacaccgtgcaggcgcactcgggggaagtcatcagaatcgcggcgactttcgctccttacagcggacgctacgtatggcactgtcatattttagagcacgaagattacgacatgatgagaccgatggacgtcacggataagcagtaaacaaacatcccccctttctccagaaggggctttttttatttatccaaaaagaaaaaataagaaggcgcttttttgcatatactgtaataacaggaagacgatgcaccctcattggaaatctggatagaaaaaggaattaggagattagggaaaagtatgagacaatgaaggagtgcacgaaaattcataagggaagaagtgactttatgtcttactacaacaaacgtaatcaggaaccgctgcctaaagaagatgtcagtacgtgggaatgcacaaaagaggactgtatcggctggagcagaaagaattttgccggcagtgataccccgacttgccccctttgcggcagtaaaatgatcgacggcgtccgttcgttggtaaatctccaaaacaataatcaaacggcatcaagttagacctcccttttacgagtctcaacatagagaaggcctccatgtctcatgagaggcctttgcgttatcatgtccttttatgatgcaaaggagcaatgaacatgaaaaacgatcggcagcagaaagatctgaaggaaatggcaaaacggcggaaaatgaaccttgccgcacagtcattcatcgaaacgcttcattttgccgttccgattctccgttttttcaaatggctcgcctcagccgcagccagctttgttcatgaaaaaacacccagcgggcgctgagtgtttttttcatgattggatgacggaaaaactattgataatgccgtggtcattttcccagactttttcgcattttttcgtatccaaatgataagcataaatggtccggaccttcgcattccgccccgtttcatccttcagacgcttagcgccttttgcttccgccatgaaataaatgatgctgccgtctttagaaaactgaggctgggcatcaatcagcggagcgaagtccttcccgtttgagataatcgttttatcttttttcgttttgacattcatcagacggatggacgctttttgttccgtccctttttgtgtataagatgtaaagacaaggttctttccgtccggtgacaccgccacgccgctgataaactgttcaaggtttgtcaggtcctgaaggtgttcgccagctcctgctgcaaaccggatattcgtcggttcagggtcaatccccttctcatttgcctcatccgttttttgataatcctctttgacggaataatgcagaagcgcaaaatcgttttggctgcggttataaaagaagctgcttacactgtcgtctttctcatcggcggcaggatacagattttcataacgtttcgttttcaaatcaaaagatgcgagacggaaaatatcttcatccgcttttccgagacggaaataaatgtgcgtcagatcctttgataaaaacagactgtcagcgcttgccgttcctttataaagcaccgtcttctttttcgtcttcagatcaagcttatacagacgcatctcattttcgtcattattcccgacaaaatagagcacctgatgggcgtcatccagcgcaaacgccggatatgccgaaagcttttcctcgtacagcacgcggccgtcctcgtaatatttcgtcatcagatctttgtctgtaatggaaacaagcagcttgtcatggccgccggagacaacggcttttccgccgccgtcgctttttcctttgatcagtaaaacggacgcgatgaccgccgccgccaaaacggcggcaagcaacatccagatccatcgtttcttcttcattatcaatctctccgtcaatcagaaaaagcaagaatcagagtccttgctttttaagatggtctattttaatagctgtagtgtccggatactcttcctttgcttaacggatatccgagcgctttgaacgctttcgggctgacatccaatacggcattcggcagacggcctacatcatttttatatactgtgataaccttttttggttttgctttcgcataagctctgattttcgttccgtttctcggaacgtcaaatcctaattttgtcgcgcaatcccagtgtcccagttttttaccggaagatccttttttaccgactccattataccatgtaatatttccgttcacttttttagcacttgcatcagaagagaaactgatcgctcccagcgtgcttcctgctaaaatcaataaggctaagaataacttcttcaagctttcgtcctcctgattctttattctaggcaaaattatacaccaagaagacgattataatatttcaatcactttacatgttcattacaacgtgatgagacatgcacataacgacggcacaattacctgttctatataattccatggtaaattatactacaaaatttaattcattagcgttataatattcatagagtatttctgcattcaatatggactttttataaggcctattgatagttgcataatatgatatattttgagaaatcaggctttaggaagcactttattccttttaaccgtggttcatattgatcatgtacctatactcgtttcaatcagactaggagtgataatcaatgaaagcggcaagatggcacaatcaaaaagacattcgaatcgaaaacattgatgaacctaaagcagaaccgggtaaagtcaaaattaaagtcaaatggtgcgggatttgcggaagcgaccttcatgaatatttgggaggcccgatctttattccggtcggcgaacctcatccgttaacaaacgaaatggcgcccgtcacgatgggtcacgaattctcaggagaagtcgtggaagtgggcgaaggcgtcaaaaattacagcgtcggcgaccgtgtcgtcgtggaaccgatttttgccacacacggacatcagggagcctataaccttgatgaacaaatgggattcttaggcttagccggaggcggcggcggattttctgaatatgtatccgttgacgaagaattgctgtttaagcttcctgaagagctttcttacgaacagggcgcgcttgttgagccgtcagcggtagcgctttacgccgtccgccaaagcaaattaaaagcgggcgacaaggcggcagtttttggctgcggaccgatcgggctgcttgtgattgaagccctgaaagcggccggcgccacagatatttacgcggttgaactttcaccggaacgtcaggaaaaagcgaaagaactcggcgctatcatcattgatccgtcaaaaacggacgatgtcgttgaagaaatcgctaaacgcacaaacggcggcgttgatgtttcttatgaagtaacgggcgttcctgtcgttctccgccaggcgatccagtcaacaaacattgccggtgaaacggttatcgtcagcatctgggaaaaaggagcggaaattcatccgaacgatatcgtcatcaaagaacggaccgtaaaagggattatcggataccgtgacatcttcccttccgttcttgcactgatgaaagagggctacttctcagcagataagctcgtcacgaaaaaaatcgtgctcgacgatctgattgaagaaggcttcggcgctttaatcaaagagaaaaaccaagtgaaaatcttagtcaaaccgaactaaaccgttcagctgaatatcagacacatccgaaaaagagccgttccggctctttttttcatctcatcgtctttccttccttttccttttaaaaatgatcccctctgcgcaaactatttttcaccctgtcccgtctatccttaggcagcagcctatgatacgtattttttaaaaaggagccctttgaagcaatgaagaacgaaacagccaaagcgtcgcttgtgacgtgcataactgagcgcaaggaagacttttaccggcttgcgtacagttacgtaaaaaacaaggatgacgcgttagatattgttcaggaatcaattcaaaaagcgctgacatcggtcgaatccgtcaaaaaccccgatgtgatcaaaagctggttttataaaattttagtgcgcacggccattgattttctccgcaaacagaaaaaactgaaagtgatggatgatgaaacgatcgagtttttaagccgaggaaaggaagatcactacaaggacacagaccttcacgaagcgcttgatgacctgccgcatcaatataaaaccattatcattctgcgtttctttgaagacctgaaattagaagaaatcgcggacatcacgggggaaaacatcaacaccgtcaaaacacgcctttacagggggctgaagctcatgcgcattcagctgacgaaggaggatctttcttaatggaaaagagattagaacaattaagagaagagtataaaagtgtgcccattcctaaggaactggacagcattgtcgaaaaagcccttcagcaaaaaccgaagaaaaaacgaatcgtgatgtggccgacatccgcggcagtcgctgcggccgtcttatttaccgccgttgtcaatatcaacccggatgccgcacaagccatgtctaaaatccccgtcatcggcaaagtcgtccaagccatcacattcacggagatgaaggaagaaaagaaccaatcaagcattgatgtgaaaacgcccgctctgtccggactttccgatcataaactcgaagacagcatcaaccggcattatatgaaagaaagcaaagagctgtatcaggaatttatgaaggcgacctcaaaaagcaaaaaaggccacctcagtatttacagcgattatgaaaccgttactgacacagcggatctgatctcaatccgccgtgatatcgaaaaaacgcaagcttcatcttatacgcaaagccgttacatcacgattgataaaaagaatgaggccgtgcttacgttaaagagtttatttaaagatgaccgttatattaaagtcatcagcgaaaatattaaagaacaaatgaaaaaacagatgaaagaagatccgaataaaatatactgggtcgaagaagatgatatgacggagccttttaaagccatccgcgccgaccagaatttttatattacagataagcacaaacttgttatttcatttgatgaatacgaagcggcacccggatatatgggcgttacagagtttacaataccgacctccgtcatctccaagctgcttgtcggagaccgctacatcagataaagaaagaaaaaaatccatgatatccgcagatcatggattttttctttcgtcccgcaacagccaagatgcataagggacccttttcatataacagacgccggactgggactgaaaagtttaagaaaatcacagcatttcatacattttttctgaaacaaaatccccttccgaatgcgtctaattaacggaacaaatggaagactgtacagaaatcagctatagctatccgcaaaacagcgagaatttccgcacacattattggaggaataccatgtcagacaagtcactgcatcaccgctatattcccggactggatggacttcgcgcctttgccgtcctcgcagttatcgcatatcatctgaattttaactgggccgacggcggtttcattggtgttgatatcttttttgttttatcggggtatttaattacatctattatattgcctgtccaaggcaatgccatcacccttgatttgcgtgatttttgggtgcgccggatcagacggcttctgccggcggcttatctgatgattatcatgacggtcatttgggtcgtattgtttaacagcgagctcctgcataccgtacgcggagatgcggtctcctcacttttttacataagcaattggtggtttatctttcatcaactttcttatttcgacagcttcggctccccttcgccattaaaaaacctttggtcgctggcgattgaagaacagttttatatcatatggcccttcctgctgcttgcgggaatgtacatatgtaaaacacgggcccggcttgcggccgcggtcatgttcctcgcgttatgttcggcagtcgtaatgagtatgatgtatgtgcccggcggagatccgagccgcgtttattacgggacggatacccggtcatttgaattgctgatcggctgcgctttagctttagtgtggccgatgaaacgattatcttccaaacggctgccgagcagcatgaaacacctgcttcacgggacggagcttgccgcttttgccgcgctgctgctttgcgtcttttacacggatgaatatgaacccttcctgtacaagggcggcatgcttttgatcagcatcaccgcagcggttcttgtcgcatgtttatgccatccgagcagctttttgggacatgtcctttcatggaagccgcttcgctggatcggaacgagatcatacggaatctacctttggcattacccggttttcgtactgagcacacccgtgcaggaaatcggaaatccggtttattggcactgcgccgtcagaatcggcgccactttcattcttgccgagctatcttaccatttcattgaacagccgatccgcactgcgggcttccggccatttttacgccgcgtgtttctgaaccgctttctggaatggaagacgtcctctgtcatcagcagaatgtcgctcggcctcattcttgccgccattctcgtatttgcgggcgggctgtcagggatagccgaagagaaaaaacagccgcaatggacgtacgcgcagaatgatcagcaagaaaccgccgcctcttcgcacaaaacggccgatcacgatcagcctgcaaaagaagaagacagcaagaaaaaacacggcggcgaaaaaacggataccgcgtcagacaaaaacaagaaagaaccagcagacaaatcagatacgaagaaaaacgacgagaaaaaggaacggtcatctcaaaaaacggctgatccaaaacaaacacagcctcagcaagacgtgctggccatcggtgactcggtgatgctggacattgcgtcatacctgcggcagtccctccctcatgtcaccatcgacggaaaggtaggaagacaagtctctcaagcactccagctcacttcggaatatgcgtcatttaatcagccgaacaaagcggtcatcatcgagttagggacgaatggctatttcacaaacagccaaattgaatcactgatcagctccttttcaaaagccgatatctatcttgtcaacacgcgtgtaccgcggcagtgggaaagcaaagtaaacgaatcattgcgccggcaggccgagtcacgcaaaaatgtgacgcttgtcgattggcacgcaaaagcattgcagcaccctgaatacttcacaccggacggcgtccatctcatacctgagggatcaaaagcgctgacatccctcatcgttcaaacaatgaaatcatgacaaaaaaagaggccccaaaaaggcctctttttcgtatatcatcaggcaagtttctgtccgcaattcgggcaaaaattcgcgccttccgttttcgttccgcagttcggacagaatttcggcttagccgctccttccgagccgtttgcctgttcggtcccctgattctgctgactttgattttgctgcggctggttctgctgattttgattcatttggttcatcatttgatttgccacattcattcccatcatcatgcccgccatgtctgaggcggcgccgcttccgctcattttgccggatgacatgccgtccgtcatggaaatctgctgatagcggttcacatcgcccaccatgccgtaagaagcgtttttcgtaatcatatcctgaacttcctgcggatagttaaagctcataatattgaagcccgtaatcgacatgccgtctccgatcagctgcatatcaagatcttcttgaatcccttttccgatttcaaatgaattcgactgcagattgaacatgtcttttccttctctggtgatccatttcatcaaaagctgatcgagaatagacgtaatccggattttaatgtcctctactaaatagctgtctctgacacccgcaatcttatcaatcaatccgatgtagtcaatgaccttgaagttaaatgtgccgtttgcgcggatcggcataccgcccggcatacctgccgccggaatgttgatggcgttttttgtgccccacttcacggtgaactccttcgtattcacaaacagcacttccgcccgcatgccgctgttaaagccaaacttaaacccttttagtgtcgatagaaacggaatgatttctgattcgatatcataatcgccgtcatcacggaaaatcccttcaatcttcccgttgtataaaaagatggcatcctgtcccggccggatgatcagacggctgccttttttaatttcacggttgttccatttatagaaaaccatgtcgtctctgaattcttcccattccaccacatttgctaactgatttctgaaaaaacccatgtatgctcaaatcctttacatataatttaaaaacttcccttgcttccgctgtaactcgtgccgcccctcgtgactccgccgtcattgtcattatctttatctggctttttttctcttgtaatgtcggttcggatatatgtgtcgtgctggctcagcacttcagacgtatcgtgatccatatacgtgctgccggtgacggtgaccttgccgccggaattgtacaccatcacggtgacggcgattccggccgctgctgcagcgataatcagctgaaaccaccatgtgagcagcagattgtcagacctgtcgtccgggcttttccccatatctttataagccatcttgatgtaagtctgaaacgccttttcataatggcctgcggaaatatctgacgagatcgtatttctgatcgtattcagccggctgctgttcaaatacgtctccgcctttttatatccggagagaaatacttcccgatccttcatatcaatagtcaatatcgccgtgcttccgctaaaatgactgtcataaaaatcaccggcatactgttcgatctccttaccgcccgttccgtttgcggtaagaatgataaaatcggtatggcgcttttctcccagcttcccggccaattcctcaagtttcttcgtttcatccttcgttaataaatgagcattgtcataaacatattgcttctgttccgcggcagacgccgatgtatgtaaagaaaaagacagcatcagaaaaaggacgaagcagaagagacacgctttttttatcgatactttcatcaaaaaccgcctcctatcataagtgagacgagtcttaatgctaaaaacgcaccggcggttatgccgccgaaccacgcggccacttttccggcactgatcggcggtttgccgacaaccttgcccgtctgcccgttcatcgcaaaaatgtgctcagcccgctcatagtcgtagctgaccatccagaccggaagcagtacgtaaaagctgctgattttatcggtctgaatctgctcatccgtaatgtcagccgtcgtatacccggagaaggtggatctgatataagaatcaatataatggctgattttatccttcgcccgcggaaagagatcgtcatcggtataattgtacttttccgctatatatcccgctaaataggccgtattaaactccttcagctcactgtatgagtaaggctccaatttgtccattaattcatcattcattttttctgaagcgtcgaccggaattttgagataatcaagattgatatcgcggtacgcgttgtaatactcggtctccgtcacccggtattctccatcttcatagtgatgcactctcgtacaaacggcattgacctgaaccttgctgtttaagtcaaacatccaaaacggcacgtacatgccggttatgctcttcacccgatcggcagtcataaatcctttcggtgtcagacggccgtttcggcaccactttttaaaagcgctcatggcttcttctttactgatcgtaaaaggaatcaccatcgaaggcgcgagatttcccgataatcggtcggcgagaacggcggctcctccgcaaaacccgcacgtcgtggccgtcgtttccgcctcagtcattaataccgcgccgcagttctcacagcggtactcgttcgcctcattttcggaaaatctcgttgttatatactcttttggcaggctttcaatctgatcctgccgcccgcagctgtgacatgtcagcatgccggatgaactgtcaaagaccatatcatcgccgcagttcgggcatttataagaaatgatcattctgtttctctcactttctctttatatcggacaaagctgcagcccgctgtctattgatctttactgaaaagcattttctgcttaagcgccgccaactcatcgtcgacactgctttgattgctgtcatatttagccgtcagctcgtcaatatcgtctttcggagacgcgttgagctcagccatcgcattggcgtgatcaagcgcccggttgaccttgtcttccattctgccgaaagctgtcagcgattggcccgcatttgacacagaggaccccaatttgttcattctctcctgcgtttttgccacagaccacttcgctttgatggcatttcttcgcgactcaagctctccgatatcagcgacaagcttgtcatgcattttgcgcatttgagacgcgttggaagaagcgagctgataagccgtttgcagctcagtcagtcttgattcaacagccgttttcctttccaaaaatgtccgcgcatcggcttcattgccggcctgcaacgctttcatcgcgtaactttccatcttttcggcatcagcctggcattctgttaatgctcttttcgcccgctgttcctcagccatgacagaagccgtctccgctttcacttttcctaaatcactgttcagattccgtaaatattgatcaaccattttttcagggttttcagctttatccagcagcgcattgatattgcttgacataatgtctttaaatcttcctaaaatactcatttttcattttcctcccaaaattaaatagtaacaagttcacagttatatatactgtttttttcgaaaaaggtttcattttctcttgaatttatgtatttttatatgaaaatagtctcattcagcccatttgtgccggcggaaattcttcacgagcagatacagtgagaacaaagaataaacaaacagcccgatcatcaacccgctcactaacggataatgcttcgccgcatacacaaagaaatccagctgcgaaatctgttccggacttgtaatcgtatccgtcccattcaaaagctttgagaatttagccgtatcattccaatcaaacgagtcagaaacaagctcactcccctgataccaattgacagcggcgagacaaagaaaacaaaaaacagaaaacgcgcattgcacaataagaaaaacatgtttcataaaaaaattcctccgcggttcaatatcacaggccgtcacactgtacatgacggcagcagcagaaacttggttttactcagaactgataaaaacattattgtatgtacttcacagcggttcaatttactggatgcctttctaaagtataccgtatatcgaaaagggtttcagacctaaataaagaggatgcttcccgaagtccgatgactttcaagaaacatcctccatactttacagtgatacttcaacctcttttaagctcggcaaagcatcaatcgcaccgattttggtgcacacgagcgcccccgctttattggcaaatgagacaatatcacgcagcttcgcaaaatcttcggctgccgtctgaacctcatccgtgcgcgccagctgatacagcgccgcgccgacaaacgcatcgcccgctcccgttgagtctattgatgtcaccggaatgctcggaatgatgtcaatatccttcccatttgaaagaagggtcccgcttttccctagtgtcaccgccacaataccggccccaagctcatgaagaaccgcaacgccttctttatgatccttcgcaccgctgatgatctcaagctcttcgtcactgactttcacaaaatcacttacggcaatggctttttttgcggtgtttataaactctgaaactcttcctttccataaatcctcacggtagttaggatcgaaggaaataaactgtccattgtctttcgcaatcgacatcagccgtaaataggccgagcaaaacggatcagataacaatgccgtcgctgatccgaaatgaaggattttcgcatcgtttaccttttccagatcaatatcatcaagcgtaaacaaagcgtccgctcctctgttaaacacaaagtcgcgctccccgttttgttttaatgaaacaaacgcaagcgttgtaggcgctttctcatccatgacgagcatagacgtatcgacatgtacggcgtccaatgtctgcttcagaaagtacccgaacggatctttgcctgttttcccgctgaaagccgcgtctccgcccagcttagcaatggctgccgacacattcgccggtgcgccgccggcactttttaagaaattgcgcccttccgtcaaatcaacatccacatcggtacaaaagaaatcaattaacaattctccaatacaaataacagattgccttcccacattatcacactcatttatcaattctcgattatagtttcagtatagtgctttctgtcataaatacaaccgtttacatagaatattttaaattttacgtatacttatctggcagccctttgctccagatcagacatcatctgctgatattttttttcagttaaaggataaaaagaaataagaataatagacagcagaatgaacaatcccggaatgagcgcattcatatttttaatcgcattcaatgacgaggcggtctgatcggtattcgcggcatatccggcgattccgagataaacggccgaaaatgaccccgctaacgcaactccgagcttattgatgaaactcatgctcgaaatcaccacgccatcagcccggactccggttttccattccgcataatcgacacaatcggcaaccattccccaagcaagcgtatttaaaggcgtcgtgaaaaatcccgaaacgaaaagccaaaagaaaataaggggaatcgaggaatacgatgtaaactgaaggcccgcataagaaatcagcgataacgccgccgtgatgatcatgacctgcttccggccccgcttcttagaaaagaaaggaataaacagattgctgatcagcgctgcgccgaaaaacagcacggttcctaaaaacacaaattccttatggctgacgttatacgtaaaatagtacaccatcgtgctgagcttaatgttaaacccgatcgcaaaagctaaaaatgaagaaaccaaaatgagcaaaggcttgtttcggaacaaaacagacaacgtctttttcattccttgtttttttcttttttcaggctgaatccgttcccgcacggtaaagaagctgaacagattcaatgcgatgctcaccgccgcatagataagcgccgtcatctggaatccgaacgcctgatctttcccgccgatggcgtccgcaagcggtgtcgcacaggaaatcgataacagaattccgatataaaccaaaatcatccgggtcgtcgtcagaaccgtccgttcctccacagaattcgtcatccgacccgttaagctgttgaccggaatcgtctgcatgctgaaggacatcccaagcagaatataagtgatgtacgcataaaccatgttccctgtctcgccgaaatgaggagtcgtaaagcataagaacgtaaataacgcaaaaggaaacgccacccacaaaagatacggccttgcctttccccatcttgtattcgtcttgtctagaatcacgcccataatcgggtcaaaaatagcgtccagcacccttacgataagaaacaaagctgcgatgaccgcaggcttaatgccgccgacatctgtatagtagaataataagtatgcgtttacaaactgaaagataatattgtacgacatatcgccgaatccgtagccgatccgttccatccaggacaggccgcgatgtttcgtctttactgccgatgctttttctgtttcaatcatcatttcccaccccaagaatccgttttcatttttgataagcaagagggagaatgcaaagatcctccccgttcactcagcgatttggatacaccatcacttttaggcattcatttttgtattgaaaggcgcgttccatcgcctcttgcgtcttctccagcggatattggtccgttacaagatgcttcgtgtccactatgccggaagcgagaaattcaattcccttcggatacgtattcgcataacggaagattccgtatatatcaatctcgttatctgcaataaacggcacattgagcggaatctcgttctgagaaggcaaaccgacaatcgccagttttccgccccggcgcacggaagccagtgcggattgcaatgctgccggattccccgctgtttcccaggcagcatcaacgcctctgccattcgtgatcgttttgatttcttcaccggcatcctgttcccggacattgatgacatgcgtcgcgcccatttttttcgcggcatctaaccgcagcggctccaagtcggtcacaatgattgtgcctgccccgtatgctttcgctgccgcaacggccatcagccccacaggacccatgcccatgatcgcaaccgtggaaccgggctgaagcttcgttctcgcggccgcatgaatgccgacagaaaacggttcgatcaaagccgcatcttcataggaaagtgaatccggaatcgaaaaaacaaagtcctggcgcattttgatatattggacaaacgcgccgtcaaccggcggtgtcgccaaaaactgtacatccgggcaaagattataacgcccttctttgcacgcttcacagcgcccgcatgtgacaccgggttcgacggcgacccggtctcctattttaaattgatcgacagacgatccgacggcggcaatttctcccgcgcattcatgaccgaggataaatggtttttccactacataattgccgattctgccatttgtatagtaatgcagatcagatccgcaaattccgacagccatcaccttaatcaacacttcatcatgattgatgtcaggcacgggcaatgtttcgattttgatttctctcgtgctgtgcataaccgccgctttcatgttttgaggcactgtgtgagtcatttggcaaaatcctttctctgctttgaaatgtaagtgcatacatttttgttttctctgttactgcccctattttatctgcttttccatacgttcaacagcctttcctgctgtataaaaggacagccgcactgtactttttattttttcatatacaaaaaacactgaattgataaaatagtactaataggaggtgcaggctaatggctgaactagaaaaccggacacaatttgcagaactgctggcacctgccgtcaaatcgctgaaacttcatcctgattataaagtcagaaggaaaaagaacgaaaaaacaggacagtcttatatcgatcaaatcgcactccgattaggcgtttcctctaacacgatcaaaagctggatcggacagatgggcgcaaactacattcccggacgaattgacgacggaaagctgttcggcatgatctggatcattatcgaaaagactgacatggatactgaatggctgaccggccttctggaaaccaccaccattcccgtcatcaaacccgcattgcccgtttggacggcgtcttgtctaaaaaaagcaaaaatacaccggaaagacggatcattcggagcgccgagtgatgaagatgttgaaaaagcagtaaagcggctgtttcatgacagacccggccatgaaacgaatgcgcttacagaacagcccgtcacgcataacttaccgtcacgccggaccgggaactttatcggacgcggctttgatatagaggcgatccggcaatggatgctgtctccgtcaccggtctgtttaatcacaggctgggccggcatgggaaaaaccacaatcgctcttgaagcagcctacctttgtgccggcggttcaccagattggcctgcattcaacagcatcatttggatcagcgctgactggaaaggattgagcttcagcgattttttaaacacgatcgcctatcagctcggacgcgcagaacaaatagacaaatccatcaacgaaaaacggttcgtcgtccgtaatgcattagccgctcattcaaacgaaaaacccgtgctgctgatcgttgacagcatcgatacagcggaacgtgacattcacgaatttatcatcggtcttccggaaggcgtaaaagttctccttacggcacgggaaaacgtaaaacagacataccgggacggcctcggggaactggcggccatccagctgagcggccttgaacaaacggatgcccttgaatttttccatcaagaagtgcaccgctgtctgcaaacatgcaacctcccgcaaaaacgggaaaagctggagcagctgcggcggctatcgcctgaccttaagaatgaattcgtctcggcagccgccggcaacccgaaggccatggcactgagcattgcatacatgtcagacgacgacatccccgctccccagctcattcaagaacttaaacaagcgggctactcattattggaattgtttgaggttctctttggccgcacatgggacagatgtcatgaagacacacggaaactatggcagacgctttgctttttcgctaagccccctgatgaaaaaagcttggctcaagcggccggattagacgtccggcggtttcattacgcgattgagcaaatgcggtcatatgctttaatacagccggaacgaagcgaaggaagaattcaatacgcagcccatcaaaccgttgtcgcttacggagaacagcacttatccgaaaatcacgaatttgaaaaaggagcccgcagccgctgggcgcattattatatcgattatgcggaaacccatataaagcgggaacagcccaattctgtctattggagctatctgctgggacggaatttagagcaaatgaaaaaggaatggccgaacatcctaaaggtcatcgaatggtcgagtgaaaccggacaacatgacatcctgatcaaactcatcatccgcatcagccattttctaagcagaatcaacctgcccctgcgaatcgaatacggattaaaagccgccgatgccgcccgtcaatcaggcgaacacacgcgggaagcctacttcaggatcgacacggcaggctgggcgctgatggaagttaatgatgcggacgaagccctcaggcaaatagaagccggcctgaagatactcgaacaatcaggcgcgccggatcacgacgacttgaaagtatggggaatcgccctgcaatcgaggctgctgttaaaaaccggagaaccggacaaagcggcagcaatgctggacggcatcaaagatcagcccgtctcccccattatccggcacagggttcttctggtccgcggcgacctgagtttcgcccgctctcactacgaagaagccatcacattatacgaagcggcaaacacaaccagcgccgcatacggcggcgaaaaaacgatagaagcctatttcaacctgggcatggcttacgtcaagtgtgatcaactcgaaaaagcggaaaaagcctttgaacaaatgctctatgacaaacacaacgccaatcaagttgagttgatctattactattacggaatggcacagctgttgtatcgtaaaggagaaaatacgaaagcgatggaatcgaatcagaaggccattcgtctgattgattcgtgggagcctgggattgggattcggggtgaggtggagcagctgagaatggtgcttgaaggaaatgaggaaatcacattgtagttaggaaagtgtgaggtcaatcttagacaaacgatctcataccttctcttttttataaacaaaaaaggtcttatctagttgagtaactgataagacctttctgatagaacgctatgagcatttcaagtgaactcaacagtcaatcccttggtatacccaagggagattacatcatgccgcccataattaccacggttttcgctcgctttcgcaccctttcaatcggtgttatttttttagtgtgatcatgaatggaaaagaaacaaaaaccgcattgtttcagaccctgacgcaactttcgttatttttgtgttattttttaaaaaataacaggtttgtttgcatcgcgaacacacgttctttataatcgtctccaaggagatgaaacacaatgaccgattttgagcgtaaagtgtatcggattatttttaatatgacccgcttcgggaaaaatccctccatggaacaattgaaaaggaaaaccgggaaagatgagcagacgatccgtgctgctgtgaagaatttgatgaggcagcgcattttgaagtgggataagcataaaaacaggtggaattttaaataaaaaagaaagcagggtatctccctgctttctttagcgaatatgtagcgaatagtaataatagcgtatgtgttttctaatgtgtattcataatacatccaatatatatttcctgtcaagcaaaaaagcaattattttacaacttgtgcttgatcttctgattcagttattttagctaaccctaattcagaacataagatttgatttttggaactgccctttaatttacctttgcttaacacttttgtctcttcaacaataaagctcttttgtttaagttcctctaaaatctcactaataatctctgctggggtcgataatgtatttattagatatcttttgaaccaactcaagcctaagaacagatctccttgtgtaccaaagctatcgtgccatttctttatctcaacaagaatttgattcataagtttatctcggtcatactgcttttcttcaataccaagtaaactcgccaaatcttcagcatgatgagcataattcttaaattcaatatgtttaggagcgtttttagctgaataataaagctcaactctttttcccttgtacattaatctactcataataggaatcatgtcactatcagctgttacaaaaacataacaactaatcgaaggatccttgtatgtattttcaatagcatcaatacaaagttcaatatctgatgcatttttacgatgatccccatcttttccatttgaataaacatgccttatttgaacacgctttttttgaagacttgtcatattacttcttaatttgttaaaatccgcatacactctaaatgaacgtacattgtcttgaccgtatcgttcccataaccttgaaaataaatttttatcttcagattgataatctggatcatggctataattattcattagagaccagtaaacgttatcataatcaacaaaaatagctacattatcaagttttctttcagaattaaacgttcgattcgaatcgttcaccacagatgtcatgatttggaatgctgatttaagctgttcgtcaactgctggttgtggtaatggctgggcaaccgtccctgttcttttttcttttaattcgtccaattaaattccctcatttcattagaaataacacacataaaagaatttaccatatattcaccaataaaagtatattttttgacttcatactagcttaaaagttatgtatttctcccatttacaacaaaaaaagcctcgtccattggacgaggctatatcacttcaataatttttcaagtttcgcttttgttttcggcccataaatgccatcagcaggcagcccgtacatagactggaaccgtttgactgcatttgctgttttcgcgccatatgagccgtcaattccgaagttctttgcgctcttatcggggtaataatgaagagccgccagcgcggtttgaatctgttttacggcctccctcgggtcaatgggcttgtcactttaaaaacacccgcaggcagactgaattttgatttttgagtggttttaggctttgaggcttttaccttcttttggccgccgcttttcagctcgttatcgcttttgatatatgagacattcacatatccgtggaatgtctggcctttagaattggtgtattcaacatatccccatccgttgacagttgatccaagctgatattttacaaccgtgccattcggcaggttaagcaccatggaagaagaggcgctccgttgtgtacgtaaaacaaggccatcgcttgaaaccaccgtgtttttgatgaatcttcctgtgtctgtatgggtaacatccggatttgatacaggcgccgttacaaccacaccatccattcgcttttcaacacggctcttaaaatcggcaaacccttgagagttgcttacccacggcgccgggcaaattttatgtgtaatgtcataatgtcgaacaatatcattggttggatcaagtttgtacattttgcacagctcggcacaaacttgtcctgcacgggcaatcgtatccggatggaaagtgccgttcttttcaatgcaaagctccacgccgatagataagaaatttgcattcggtttcagcgccgcgacaccccggtaaggctgcccgttgacgaattgctgaatgtcattcgcatgataggcaacctcattcaacggaatgatacaaatagcctctgtacgatcgacaaagatatgtgcagatgcaaacgtctgttttttctcagatagatttctgttctgtgcggggagcgtttggccaaaatatctataatgattggcagcaggcgcgccggggttggccgtgtaatgcaccacaagtttcttcacgccgttgtttttgattcccggccgcgtccatttattaatatcaatatattggtttctgtatgctgacataaaatctctcctattctgtttttggattcaaaaaagcagccggattaaccagccgcctgatcatctttttcttttgtctgatcgttgtcgctttcaattacgtgaagccggtcagtgatgacggccggaattttaacgccgatctgcgccaaattctccgtgatggacaggccctcatttgcgatataaaaaagaacggttccaaaggtcaggacgccgttcaaatttgttatcgtatcaataatgttggcgacgatgaccaccataaaactgagcatcttccgcacatacccaaaccacgcgctgcggctccggagctgcttcattttccacgctttgataatgccggtgatgacatccaagatgctgaggattagaagcaagtcaaggtacttcacctccccgaaaagatatgttcttgcgatctgtaagctttcaaaattcatccacacatgtattccctccattttgatcacctccttcgaggcaaaataaaaacacctattcagttacaggtgctggttcactattattttctttcgccgctactgccgcatttaattgcttttcgagttcctcgcgtttattatctgtaaacgtgtatagcgctttatattcggccagctcattgttcttcagattcaattcctgctgtagggaagcagctttatatgctgctatttgtaactggtcctgaagttgctcttttgtcatttcttgcatgcctttcactccttactcttgatcgggatacgcattaccgcgttcgctttctgtaatttcatcatattccgcttgtgtgatgcggcctttctcaacggcttttctcatttcaacggtcaaaacagttccgtttttccagcaatcctcaaaaaacccgaaaagagcacttcggttctccaatgggctccccccgtttccttttattgattcattaagagattgcaaacccgctgaaggtcaagaacttgttcctgcaacttttcctctgtagtcttttccttctctctatcttttgcttcaatatttaataccacgggctcaagcttcatctttgccatcctccttattttgaacatagattgttataagcccttctcggttgccttgtggatcaacgacaatttgaactggaatcataataagctttttgctcccactgtacccttgataataaccgtcaggctctacataagtttttgtgagcaaataacttatttcatcagcctttatatcatgaaggacatataattgatacgctacttttgttgtatcgtccggctgcagatcgaacgaaacagcctccatgggatatgtcttgtctcctttttttatagagccggcagttatttcaattcccgcgccggtttcttctatttcgatgccgtccgcataataaagactcatgttaaaatcccttttttcaaccataaaaattactcccttattgtgattcgtaaaaaataacaatttgaacctttattgtttttcccgcaactccggcagtagtcccggtccctctcactccaatatcaacagaactggcgcttatattttctaatcctaccgtaaccgcattagaatatgcgccaatcgctgtacctaccgccgcaaaaacgttctcaggcgcataatcaaaactatcaacaaaaggaatgcgattgtagcgcgcgtacgcagttgcccctccgtcaggcggcagtttaatgtcccaagtaaagcagtaaaccatcaaaccgtattgtaggcctccatgctcgtcttctaattctgtagaaacattgccacccatcaatttgaattcgcaattttttgcattccctgctacaactttggttcccaatggcagcgttaaatctgatgcatcaacaatcgttttttggcctgatttcagtcgaatgaccccggggacatcaatatctaaattattcggtttaaagcgataaatagtagctgatccttcaaaaagggcctgataacggttatatgtgaacggctctcctatatttttaggattggtagtagcagtaagaagaaaagcgtcttcttcaacagctgcctgtctttccattttcatattaaaatggcttataacttgtccaacatctcctatttctgaatacattgaaatagttggaaccgtttcatatgcggtttgcttgcctgcgccacggagctctattttgccatcaccaattgaaactgttctgtagatttcattataggaatcaccaggatcaaaaaactttccttgttcctgcgttattttcccagaactaacaatcaatttgttgtaaacataatgagagtctctggtgtactggtaaatcttatcgccttcgatatagtattcggcatcttctgattgtgtcagcgcctcgaaacgggccccttttatggtcaccccctcaatcgtgataccttttaacgtcccgacatttattttgtccgctgaaaggtctttgatcttggcgtttgttattgaaccgtcaatgatgtgtaccgaatcaattattgcttcttttagatgcgcctttgcgatagccgcattttgaatagccgctgtcccgatagccgcttcagctactttcgcacttgttatggctgcattttttatatgagctgtttctattaccgccttttggaggtggtcgccatcaataacaccatcaaccagctgagtatcaaacgggctataaccataatcagaaatgacatcgcctttgcgcacctgtaccttacgaataacaaagctacagggctcagtgtttccgtttcgattatatccgccgattccaattgtgtaatcagagccggtttccggagcagtaaatttgatattaacccttataaattggtcagacggaaaagcagaaatatctttctgttcatcgctgctaatctgtatgaaagtgctgccttttttcaaatgaatataacttatgtcggtggtattattccgttttatttcaaatgacagtgtatattgttgatctttgatcaatgccattctttgaatattaacaggcgatgacctgttcccgcatattccgaaagctattctagttgttccattgatgatctgagaaacagtcatttcattaaattctttttcctcaacactgtggctggtgtccgtataatcatagaaccatttagattttaaaagagagccaggtaagatattagcatcatcaaagtttcttgaaagtttatcagcatcaacggccagctgggccagtttttcctttgtgatcgctccgaaaacaatgtcatcagtcaaaatgcgctgagtggtcgcggaaaactgatccgtgaattcgctcgctgtgcctcgtgtgttgattgagcgcaagcgataataccaaacttcatttactcccgtaaaatgctcatatccgcctgttttgcctctgaaaatacgattctcttttaatggagtgaatccatttacttgtgaagcatatacctcataggctgcaatataactggacggatcataatcccatgtcagggccacattctgaaacattgccttgatcactacattcgacggaactggcggggctttgtcagggaaacttccatccgtaacctccccggcatccggtttgctttcccaagtaccgcggtttttttctatcacgctttcaatttgatcaatccggccgtctttttgtaatgctgataaaaattggccgatctcaacaacgcaagtattttcagggtcggtaatatcgtattccattgaaataatgcgctgcgatgtctcgattgggatagcgaagtttcgatcaattgcgatcgttgtatctcccaattccacatgttcgtgttcgtgtcccggcacgctctcaagcagctgcacagacaactcataattgatttctgtcttacatgcagtcgttatcaaatgattatatgtggcctttaaaagctcttccggctccgttatgtcttcatcattgtattggccttccctatggatcaactttccatctttaaggcgccccaatcgttctaataaatccggatcgccaacccattcctggcctaaaggcttatcgaccgggtcgccttttgattttttccattctacttcagagaaatcaataaaacgagaatagccgcccgtttcctctccttcctcatccgtagatgctatggatgccccgtaaccccaaagggctgtcaccgggtaactgataacagtccgccggatattcgttgtatccttatcactctcaaagcgcttcccgctgtctttaccgcgacggggaagtatttttatgattcgtttgacgaccttatttccatcaaattctatagtgtcctgaagctctccgccccatatattgatcacgtcagcaatacaatccaacgctgtttttttatagaaggtagtcgaattcactccaagctccgccgttacttccgccacccatcttgaccgagaaaggacgttgtccagtacaaactgagcagttttgttagttgggcggaaatcttttacaaatgtttcggcaagctccatcatggcagcctcacaggtaacctgggtgttaacctctccttcttcgtctgcatcatccagttccttgatgacaaacagacgcattacaccgtccttatccttgaataccacttgattctcttcgaataggaagcgcgcatcagggtgggaggcatcggctacaaaagaaaaagaagagcccttgttgagctcttctttgtatttcgcatcccagaacgtacaggtttctcgtccgtggctggacagcactgtcaataatttatcatctggtgaaagtatataaatgtcagccatgaccggacctccttacaaatatgcctcattaaatttgatgctgctcttatgactgaacttgattttaactggcgtcctaggcggcagcagaaaccaatctgattgaatttgaagtgctgtcatgattaaattaccgctgcaagtgacttttctttttgcagaatcaattacaagtgtgtcaccagcgatgaaatcgtacagcagcttgatcgttttcgatacagacccatcaccattaagaagagccacttcatatgaagtggctttctcttcaaagacgcattcgattgtcgggtctacggccgcatagcccggattagtgatagtctgaatacctgaattaaattcaaaatccttcgccgggccgtatttttttggatcaggacagataaaagtcaatgttgcagtctgaaagcctccctgttcttcgccttctgaaatgctttcaaagacagcattatagactctgtcaggctcatcgtgaaaaattaacggtttaggttcttcggtgtgcagaataaaagtcagttcctcctgctttttcttcagctcttcttcactgctgaaagcaaaaagaacctcaacggttatgactcttacaggaattcttgtgttccgcaggaaaccgccggggcgattcccgatagtggctgtattcacttctcttccggtcactccccggccgcccgtggacttcacataaaagaagggtgatatatcaatgccgtcaaacgtgattttccattgattaggcagcagttcctgataattgatcaattaaatctcgtcctccttgcgttcgaccttttctgagcgtctgtgaccggtttttctacgccttgaccgaccttcttgctgtccatctcaacaacaatcatcctgtcaggcaattcaaggttccggatgtccgcgctcaattcttttctaaccgtgccgagttcgctgctggaaatggatgtgtcatatgcaaaattcagatcctcctgctgaatagtcatggcatcactgacgacgcccatagctttctgaacagtgccgataccattctgaatccccacagcgataccggcaggaaccatgaccccgacctgatcccgcatcaatctggatggggaatggattttcaatttcttcttaatcgttttttcaattgtcgaggcgatggaatttgcttctttcgccagctcgcccttcatattcttcattccagaaataatgccggccattgtatttgaaccgatggcttttccgcttttcttgagagaaccaagctgttttacatccactgtaagctccccaattttgcggagatagtcatttttcaaaagtgccagttctttatttgcggcagaccgtaattcatttattttcttggtcgtcgcgttcttcaacccggttaattcttgagcagcctggtcactggccagcttgtgcttttctttccacagactgacatactcatttagctctgaatctgtcatgcgggctattgcattaatctgatcagctgacccgacacccatttctttcaattcgtctgtgaatgcctttggtgcccggcttgctatttttgtaatgtcagtgttgaacgttttgatcttgtccagctgctttttaagatttgaagtcagcttggagccgttcacattttgacttgagacatcgtcaaatagaccgatggcgttataaatcgcgtcagttcggtcttgcagctcctttttataggcatcgttggccgccttaatatcggcagtcagtttatcattcacttttttgaattttgagagataagtattgtttgcagaaagaatgcccttgttaagtttgtcagccgctttcttttcggcttccttctgctttctggccttatcagtcatagctttttgagtctgatagatttcccgttgaacctttatttgctggtcagaattcagcttgttcttcttcttgattttctcaagcgttttgatataggtattcccgctgatttttcctgtatcgtattttgcctcagctttcttaatctgatctgatactttcttggtatacgccagtttcgccttcgcttccttgcgctgctgctctttcagtagcttcttctgtttatcagaggcgcttttggatgcctgatatatctcgcgctggatttttcggttttgctcactggtcagcttgttttgcttctgaatcttctgcaatgttttgatatacgtatcggcgcccattttcttggtgtcatacttcacttcagcgttcttaattttgttggatacctttacctcagccgccttctgagccgctttcgctgcttttgccgcagccgcttttacttttccctgtgatttatcaatacctgccgccataccggtgccgacgtgataaccgacctggtcacgcattacccttgacggtgaatggattcccagaagctttttcatgccgttaggaattgcgtttgccattgatttaactttgctcgctaatgcacccgccatgccgctgataccatttattaagccttgtatgatgttgcggccaatggacttgaggttgatgcctctaaaaaatttcatgacactattccaaatgctgacgatacgttcttttgttgcttggatacggtttacgatttgcgctttcatgtaactaaatgctgtagaagccgcgcctttaatgccgttccaaatggacatcactttgcttttcactgtattccagaggcttattactctgtctctcgtcgctacaattctattgacgatttgcgcccgcatgtagttgaaggctgttacagctgcactttttaaagcattccagacagatgtcactttgctttttatcgcgttccacaaactgaccattttgtctctggttgcaataatccgattcacaatttgtgcgcgcatataggtgaaagcagtcactgcagcacttttcagagcattccatatggacgagactttactcttaattgcattccagatgctgatcattttatctctcgtcgcaatgatcctgttaacgatctgggcccgcatatacgtaaaggctgtgacagccgccgatttgagacctgaccaaattgatgtaacggtgttcttaatgccgttccatattgaagtcgcagtctttttaatcccattccagacagaagaggcaaacgattttatagcattccaaactgttgtgaaaatggttttgtacagattgaattcccacttaaaaaaagcagatagcccgttccaaatggttttagcagccgaaacaattccattccaaacagtggagaagaacgacgttattgcgttccatgttgatgttgccgctgttttaatgccttcccatacagattggagccactgagatatgacaccccaaacttgaagggtgtactgcttgaccttatcccaattggcaataatgagaacaactaaggctataaccgccgccgtaatccacccgataggccccattgcgatgacccatgatgctgccatgcgcgccgcatttgccgctgcttgagccgccagaatgaccaagcgtttaccaaataagatcatttgcttaattcctgccgccaacattgacacaaatgaactgatttttgccgcagtccacgccgctgccatacgtgttgcttgggctgctgattttgctgctaaaacagttattctggcaatgaaaagtcccatctgcttaatgccgtttttcagcattgttataaaagaaccgattttcatcgcagtccatgatgctgccattttcacagcattagctgttgcttttgctgccataacggtatatctcgcaatgaattgccctatagtaactatcgctgattttaattgggtgatcaatccggccattctaattccggatgcggcagaactgaaactccgaatatatcgagcagcagtcataaagtctttaagcccatttgttacagcactgactgctactatcgccggaacaatagctcttaaagcaccgattaatgaaatacccgccgcaatgaacttcccgattgccgggtttgcttccatcgccgcattagtaaatttcaaaaacccgtttacattctccaaaatcgttttgcctagtggagccatgccaacaagcaagttgatgatagttttcgcgatctgccccaatgtgctccatactgtagggccgttggttttaatatagtcaatgaacgattgaaattcttttgttttcgtaacgctgccagcccactcattgaaccgcttggtcaggtctacgagggatgtcatcatgtcttgagacataggagcgaatccagtaaacagctttgtcaggccgcccgaaaagtttctgataatctgcaacaattttgggccgttggtttttgtatactccacgaaagcctggaatttctttgaggagcctaagttcgctgaccatttcacccatgattgcgtcattccttcgatagactttgtcatgctctttccggtcggtccgaatgctacgatgagattgaaaactgtccgcaagacattcccggcagatcggccgaatgaagcaaacgccttcggagcttctttgttcagataggaaatgaatctctgcatgtccggagccttgaaagccttgtccatgctttttgccagtcccacgccctctttcgccagcccgtcaaacattggaatcagtgagttaagcgcgagtttgaacgtattaagagacataccgaatgtttttaagatcggcttttgaaccatcgtaccgatgtcccgccagttgtctttaaagtcttcgaggttctttaatgcctctctctcttcttttccaagagatttttgcagattattgatctgtttcatgattttagcgcgctcttttgcgcttgttgcattgtccagcttctcctgtagcttggaaaggtcttcggatgctttgaatacaccgcttatcgaagtaatagcaagggcgccgaatgccgccgcgcctgttcccgctgttgcaaatgcactggttaaccccattactccgccggctgccactccgagcatagggcccaatgagccgattgctccgacaatacttgcaagggctggcgagattgcaggaagtagggacgttaatgccccggcaattgaatgaccgatgaccgttgaaactgagtttgtgatcttggcaagcctgttcattgacgtttcaaaccgatcaattcgagcttctatactaatccatactcttctcggcaaggacgccagagcagcgcgtgccgttgccacagagcgcataagcgcagccgtgtttccgtttatgaccgtggtaattctgtttggcagtgaagccaaagctgaacggacagccgaaaccccgcgcatgataggcgacgtggccgcattaaaagtggtagttacgttatgagatactgatgctatggctgaccgcgcaacagcgacagcacgccctaaaggagtgggatttccgtctatcgtcgttgtgattctgttcgccaccgccgatagccctgctttagcgcgtgccaatgcggaagataacggccgcacattccccattaattgcgtggtgacagtttggggaatctgtcttaatctttgcttcgcccaattgatggcccgagttaaagggtctgaatccgcatctaaatcaactcgcgtgcgttgatgtcgatgaacaaagttatctatttgttgcgccgcctgccgtactcttgcctgaaagctggcaatctcggcgtcaacctcgactgtgtgatgatcagccatccggcgcattatatcgttgacacgatccatactgcgattaaattttcttgtctgtgcttcaactattgctgtcagtctttcgatcattccctcaccccattccttgtccgaattttgcaaagtggttgcggattgcatcattaaaccgctgaacccctttggctcgtttgccgagctcgtttacatctgacttgcgccatttgtcgttatcgccagtgatattgcgctccaattggcgtctggccttcttcgcatcaaacattttcgtttctttggggcgcttctcattcatggcgtaacgatgaaacatggcgtttcttgccataagctccaattcatctatttctcgcaacttggctcctttgagcagaagcttgtactcgttaggagtccatgacatgattaaatccacatcataaaccccgagccaatgtgcggagttcgtaattatttggtcgtagtcgatcccgttctctctttgtatgcctctttcatcatcttcaagacttccttgccgttctcttcgtcctccaaccgtttcgcttccatttccggtgtttcgttcggagctggtttcttccctttgttcatcttctccatcatcttccaacgctgacggattacgcctttgaaaaaacccgctgaatccagtgttgtgaatgcttcattgatcatcttgtcaattgcgtcgcctgtctcgtcttcatcaatgattttcatgattgcttcttcaatagcctcagttgatggcttttctttcttcaagtaagcgagtgcacaatcccaaaaagcagaaagataggaagcctcttcgttgagcagactcatgtaaatattcattgtgccgcctttgcccttttcgtccgcagtggaatatttttcgtttgccaatctgtcaaaagcaaagtcgcagcgtgatttgtattctttatctccgatagttaagtaagccatttataaaacctccgattatttttgtatgttaaaaaagagcccgggaagcccggaccctatgattccttttctgttcgtatcgtaaaattggccgatcgttccgattccccagccgagttcactgccgacacattaaaaatgtaggcagtgtccggcttcaggttaggattcgacgtgtacgaattctttgagacagtcgctatttttgcataaaacctgtaaatattgtaagatgtcgcccctttcaccgcatcccatgaaaaactcacctgatttgaagtggcgcttttcgcagttatattgcggggaacgttagggcgtaaccgcttgtgtttgcgtaacaatctcagtcattgaggactcacccgcatcgttcacagcagagacgttgaccgtgagtttcgtatcggccgcaattcctgtcaaggtgtgggatgtgccagtgacagttgcgtccagctgcttgctcgctcccctgtataccttatatgaagttgccccatctaccgcatcccatttcacggtcacgctgtcagctgtagccgtgaacgatagattttggggcgcattagggcgtagttgtttttttggcattctcgccaaactgcatgaactctttggcaccggcagaagatctgatctcgtcaattaattcttgaggcagaggatcaagttcacctttacgggtcttaccgagaacaggcaatgttgttgaaacctcaataaacccatcttgcggtgcacttttttctaagttctcgatgattgcatgtccatattcagaatcatgcttatcgtttttgtttttattcaggtttactttccatacctgaactgtctcttcgttgtcataagcatcttcaatcgccgtttgacccggatcagagacagcagcatagtatgtcagttcgatgctctcagatttagggccgtacccaacaattcggccagactttgttgattcatcttttgtatcttgttctttcgtatgactgccttctgtttggaatgcgataaacagaccttcagttgaagtagcattcatcggttgaacaaagtaaacctcatcaataccattcaataaatctgccattttgttcatcctctcaattgtttattgtgaagcgcattctgagaatgccgtgacgcgtgtacccgtcaatatcggtgatcacctgcatgctgcgcaactcagaacggcataaagaaaagccctctattgttaggggcctgcttgttaacgcttgaagcatgaggctcaaaatctccatcgcttctttttttccgttgtaacctgaccagcagtgtaaaaccacattgatttcttcaccgctggatgtcttggttttaaatggggatacatcatcatcgcccattgtcacataaggcttttgctgatctttcgggactgcatcaaagacgcccgtgacgcgcccgttcagctcttcgtctgttgataacctcttaaataaagcagcctgcaacggccacagggcagatcgcatgatgacagctcctttctatcacatttgactggcaaaataccgcatgccttcgtccaccgctggattccagaacggctgtgcccgcattccccgcgtgaccacccatctattaagcttggtgtcataataaacccacggcgtttgccggccgccgccttcctctgcgtaaatccctgttccgtattccacatatacggcataatcggcaccaacagaaataacggcccgtaagccgccctcttggtagtcgatttcaattgaatttttcaagttcccccgtctattgcggcggtcggagcattcagaacagcgtggctgtaaatcagctcggccgtgtctgtgaccagttgcttaatatcatctatgacccggcttctgaactcgcttgtggctctttgcatctgcctgacccatctaccactgacctcagccattgcccttcagcacccccgtaacctgacatttcaaattcataatctcatgcatgccgccctggtcgatcggatctgatttgagagtcagcaccttgttctcgtagatgatccgcattgtcttctcaatatcattgcgatacgggaaatacacattgaaatcaaccgggttctgaagctgctgagcctgataatattcccgggacgtaatcccgccgacaaaggcctctattgtgagataatcagtgaatttttcaacatagcccccgccgccgtccggcacctcttcccaacgctgaaatgtaacgatatgcgggaattcttcatagatcatatgactctcagctttctgtatggagcaagaagcttcgtaatgctgcttggcagctctgtttcataagaatatgagacatctcccatacttcggcctgaaaggttggaaggagtcatgttatgctcgatcgctttcgcgacatacagctttacccctgctggtaatttttcatctccattgaccatgaatgagttgttgcaccagtctttcgcttgatctatgaacagaggtaggacctcggccagataggtatcgtggctgtctgtttttatgccaagcatattttttacggtttgaacatccatagaatcacctacacttcaccgagaacaattttgatcagttcctctttaggcgctttgggatcaaattcatattcgttctccttaagaaaggcaacgatttcatccttattcacctttttcaattgctcttcagtcatatcaagaaggtttgtacccggccgttcattcagctctttagattgtttggcctcatccactctcttaaaaccaatgtgagaataaaccacctcaaaagccttttcagtgcattcaatagttttggaaccgttagatgctttcatatcacgcgccgcctccttccagtgcttttatccgattctctaaatcagatagtttggctttcacatcgtcaccgagtttagctaaagtaactgccttggcaccgatgttggcattttgtacactaccagtgccgatgttacgattttggacagaacagtcaccgatattgatgtttttcacttctccgtcgccgatcatttccgaagtgatagttttaggagcaggcgcagaacccgataacccagtcaccttcgcaccctcttttatttcgagctcgccgccgatcaccaatttgtcgccgttattagtgctatagtttttagatgtgtaccccataagcttacgcctccgttgctggtgtaatagcagcaaaagcatcatcggtcagtgtcatgaatccgacttgctgagttacacggagagcaaccatatctctctcatacaagttgatcgggtttccgtctgcatcgacaatcgttgtcaatgttgcatcctctgagattttgtattccatgccttgagggattccgtaacgtgtgtaattccagtcagccgcaagtaatgccgctttttcgtaatcccatgacttagaatccacatatccgatcggaaggccaagggcttgttgtgtggcgccgcctgtcgcatcgttgaagatcggaaggccgttaccgtccttagtgccgcggagcttttgacggaatcggcgtgttgttgtaaagccgtttacatctttgtcagcgtcttcaacaagagccatgaccccgtttaactcatcatatagattgccaagtgagtttaacgcaattgtgttaccagattccttgattttttcaaatacagatacgccttttccaaacggtgaatctacaccgaataacgcagcctgatcaaatttgatcgcaaaggcttcagcgatagcagggcgcatttgtgtgaagaaatctgttacagagtagcgcaagaattctttagaaacagggatgatgacacccaatttctttgaaatcatttttgctgttaaccattgagccttagaagtttggattctctcgccttctccaacccagtaagctcccggtccagaagccaagtacgtgaattccttctccggcttactcatttcttcatattttgctagttttgtgacagcagattgggtcataaactcttttaaaaccagcgttccttgttcggttggaaccttcccatttactgagtcttgcattaatgcattgtttggattaaatgttggcattaaaaatagccctccttattttctaatacttgcttcagctgcaagcgagctgatgtctaaatcttgatttgtcggttcattgctaccggactggacatcacggccattctcttgaaacttggattcaatagccttttgaagtgcagcattgtacttctcttcgaatgctccgaggttcttcatcgttgattcttcatcctcaccgataaagaattccactacatctgccggcagttgcttttcagaagcataagaaacagctttgtttaaaagcttttcacgttgtgccgctgtcttttgatcttccagctccttttcgagcttcctgatccgcttctgctcttctgtttcttctggataaagctcttttacctttgcatcaatcagagcatcgaggttgttcgccttccacgtatcaagaccttttgtaaaatgagaatccaaccgaggctgaatgagacgttttccttcttctgtatctaaaaacccattcaccttgtcagcagacacggcagaaagttcattcagatacgcctttacatcttcgttttctttattttcttcgagaaattttttcacatcttctaaagttggcattacgcttcttcctccttcgccctctacagtgcgcgcctgttatgagtgcatgaaaaataagccttttaacgtcatgctcaggacaaaataaaaagccgctgtttaacgtcttcccttttcctcaatggatttgtaccactcttcataggtttggtatggaattgtttggcctgccccactgccgccttccctcgcccttctcgtatccggcagcacaccgtttactttaaaagcaatcgtacaacggcaatttatgtcatctttcgcattattcatgtgccccggagccggcccgactccgccgtaaattgatttgaacagcccattgcgttctattgtcttcccgtccagtttcctgtgcccggctcgtgttttaagatcaagagtagcattccacatctttttaaggttgctccgttttgaggccttctcagcgctttccatcctcgccgagacttgtaccctatgagcttctgttctcgccacgtcacgggctttcctgcgggcaaattcggtcgctctttcaatgcggcgggcgatcttggaataatcctcccccgcttgtaggccctgtgcgacggaaatttgaatctgccggacataatcgtctcgatgccgcctgtaaatagctgacaaagtcaattcagctatagggtttagaatggcctgccgaatgacttcggctgtcgggatgctaaaacccaagttaaccacggattccatttcaaatagataagcagaacgcatataattctctaaaaactgcttggctgctaatgcctcaacaatagtcagaatggttttgaaagccttgtgagattcctcggccatcctctccatttccttgttcagacgattgtatttgttggcatcggctaaagtaagctggccgtccttgctgtacttcgcatacagccgggcaatttgtgcgttgatctcctttaagcgagacgcaaaaacgacatcaatcttctgagcatcctcagtgatcatgtcgtccaggtacttatcaatatcattctggttcatcttcatcaccgcccgcgtctgtttccacatccgttaacggcggcatgttgagcctgtattcctcttcttcctcttccatcttcttcagctcatactggacatcatcaacaaacgacagcagagataggcgagtttcttcgcttaccattcctttaagttgccctgtcgtttgtgcttcttccagtacatttgccggaaggtttcgcttaaatccgaaccaaacttttttataatcttccgctgccgctttccttttagtgccccatgcggaaaagatcagtttgtattgataacgcagagcagcagtcattttccgctccatcgtgatgcatttgttttcaagcgacatcaatttatatttcatcgcaacccctgaaacattcccaccaaaagattcatcggagaaattgaccgattttgcaaagcgaaggatattctcttccaacctatcaagatggttttctatgatggcatcgtttatatcctttgtcagatagcttacgtcatctttttcgtcaagcaattcaaggactccggtctttttgagctggtcaagcgtctcttcatcagcgcccaacccttttaaaatcaggtatgccagccgatattgctcaatctcattcgatgcatcggacaacgtgcggtcatacgcatcaattaacgaaagaaccttttcagcatctccctttagttccttgttattcgctaaaccgaataaggggcagccatcaaaaagatgcaatgtttttttatcaaaagtgaaggctgagctgtctttcgtactgaaataatagacatatttctgatcatagaattctgctttgatctttccgccgtacaccgtgtaatatcgcaaagcataagcaggttcatggatacttccatcagtaataaaggcgcattcccatggatcaatattttttatacgctcgtttccagaacgatcaacgtaagcgaggcgggcgccgtaaccgcaaatagaggccattttcccccactcgctgtcttcatcagcaatgttattttccatattaaaattttcgatcaactgttttacaggtattgcagtgcttgtcgtatcgctctcatcaaactcatatgcaatagggtggccgaacaaatagcccacctttgtatcaatgatttcagagtcaaacgagttgttaagcctattgtttactttgtgatcaatacgttttaattttcctgtttcaaaatcttcgtattcaatggcttctctggataagatcggaacgccttgaacctcagcctcgtaccgttcataaagctttttcattctgtcatgatccggcttatgttcctgaatgatcttgtcaatcaattcaggcgttatgccggactgttcaatcatgtctataaaatgattcatcagctcacccctctccgtcttttcggtttattatgcgaatacagagcgtaccggagtgagtccagcacgtcgtcccattccttaaccggttcgcctgtcttctgattccagacgtacataaagatttcttttttgaaccggtcaactttgtcttcaacaacaaaaagctgttcttgtttgaacagccgcgctacttcttctataccggatacgacagctttatcagcgttaatagcccgaagtttttcacgccggaaacgaacaacgtgttctggtcgtgccgtatcacaatagaaattaatgtttccgtaccgctcttttacgcctttcgctaccttcacccagtaatgaatttcctcatgttgcttggcatattcttcgagcaaataaaaacacccctggtcatcttgtccgattacaacaatagaacccgggtgctcatatccccagtcaacgcccgcaaaatacttcttgaaattgacgcgcctgttttccaattcctcagagctgatatagtggatgtccttattgaaatccttgtatatgactccttctggcgccacccaataaccgtgtatatcccgatctgtaaacatgccgctcggcgttgatgccacgatgctctccacatattccggatcgagaaaattgttgtcgaacagcgagaaatgaaatgacctgatgttcagccgcccgcttttcagcatttgcccgtctttgtcgatataatccgttttgacggtgtgcatcgggttttcgggatttgtatccatcatgaccacagcgcctttatacgagcaccgggaaatgacttctttcacgaatgaatcgtgcagggcagtcgcttcgtttaggaatgcgccggctgatgtgaacccccgcgcttttttccatgaatcagcattggctccatcaaagcaatatacacggttgccgaatatttcaacggcattcgacttgtcgagcctcaattctttacccagaatcagttccatatcgttcaagacatttcgttttatggctgcctgagtagccccgccgatgatgaaggataaacccatattttgatacttactgacgtgagcaaggaacgtcaaaaggagcacgaatgtttttcctgccctctttgcgccgctacaaattagaattttgggttgctctttaataaagctgtcccaaacttccttttgctttttattcagttccatcggcattcaccatttttctcaacattgcagcaatatcattttcttgggtgtttccatcgccgccattaacggtcttcttcgttttctcgatattcaagcgcatctgttccaatttaagacgccgctcatcttgctcatgcgccagctggtcaaattgcttgatcaagctccggagctcccccattgcccgagattgagcgtttaagagagtcgcatgacgatcccaagcgaactgtatttcaagttcttcttctacaatgtttttttcatatgttagattgccatcttcgtcctcatcttgatgataagcgtattttgcctttttaagctcttttgccgtatcatctttattctgcacaaacataatgcgctgcgcccgaataatagccgcatattgtatctgaatctgatcccatatcatatcagcaggggaacgctcctgaatctcttccatgatttcaagcgtttcttccggcagatactttgagaagaacccatgtgatacagcattttgatttcttgccggagccgccccgccgctatttcctaatgcgtttttgttgccgggttgcccgcctatttttgtgtgcacacttttttcggtgggtgcaccctttttcctttcccaaccatgccgctgcttccacgatttgatggtgttcactgacaccccgtatttttcggcaaggtccttgtatttcacgcctttgacgtaatccttatacgcctgaatgtgcttttcaaccatctacattcaccgccgcccccttctgattcgtgtttgttttggaaaatatattccctctaaaccgacgccgcactcagaccgttaaccacctatagttttcctgagacttaccggaaccggtttacaaggaacaaaaaaagcacccttaaaggtgcaggtgctggctttcatttgattctatttctttcataagcgaaaatataatatcagccttaattatataattcattggatacttaataactggttgctcctctttctcacaatttatatagtttactatttgagctgtattaataccaaccaccttattattataaataatggggccgccgctaaaacctccataactaaacatattgcccataaaatagtttaaatggttatggaacaaagacactttgccaaatgaataaataggaagatgctgatttgttaacataggattgacgacacctaaatcagaaaagtcaggataccctatcaaacatagatcatctcctggcgttaactttttatcagaaatgtgtttaaaatccaaaggtgtataatcggatgattctaaatttctcttaaattcaattgtctcattaaaattaagtgatataatagccaagtccatctcaaagtgattattttcataaactacaggcgcctctccagactcaccagatcctaatcgatatatttgatcgacccctacagttttgagattctcagcatatttgtttgctttgtttatagattcatggagctttcctgaatttctattcacaattagatgcttcacagtaataagatattgcttattaccttttttcacataaagagcagtaccaaagtcttgtttatcttcactgtaacattttaaatgaacaattgatttttctattcttttcaaatccatatttctctcaccacttctagaattaatctgaataatataatatgaacaaaagtaacttaatgaaacctatccttttttcttctgtttacttgccttccaatccatatactcatggaatactgtaggtcctgtcacatcgtattttctaccaatccgccacaactcatcttgcatatctttttcaatatcttcccatgatctatgcccttgtttctctaaaaaatcattaaattcttttaccattggcatcatattctcacctcccaccttattatcggttaaggagtgtgataaaggaactatttgcaaaatttgtcgaacgaaagcacttttcataaataggtggcaaccgtaagacaaaaaaacacccttttaacagggtgctcatttccgcctatgtttttggaaatctaaaatatcctctttcagaaaaagcctgtcccggggcatttctttcatcggctctaattccccggtctttactaactggttcagatactgacgggtgaaccccaatatctcaagcgcctcacttgtattgagtatctcttcattcaggaatttcttgattgcgtcacgctctttaggcttgtacatttttgaatcatccttttttctcacgatatttcaagtaaagggaaaatgctttctcgatgatcgaaacaacaaataaaatgatcagactaatgtcgagagccgttttcaacggtcccgctgccacatcctgacggaaaaacagcatatacgccagggcgagaagaacaacaatatcagtagtggactgtacacttttcatttttttgaaagtggctggctttcaagtatttttctttagtcgccgcatttgctatacttggagcaagggagaagcgctaccttctccctcggctcaaaatcatctgcgctttcttggacgtctgcgttttttgattttgggcttttttgctttaagcttttccctgatgatgaggactttctcaacaactgtgagagttgtgaggataatccccagtaccaatgcgatttcagccactttctttccctcctttctatacattaattatacatcgtttatttactcacgtcaagtaatttagtgggcttttttcattatttctccaataaaaaagagcctattcacgctaaacagaataggctgtgatctgctctatttttcattttcaggcgggaacgttcgatgttcttctgcacagttccttttttaatccccaataactgcgctatctcttcgaatgacatgttttgtacagcatgcatcatgaaaatgtctttttctctttcggtaagcacggatagggcatcagcgattctttccttatcccaatcacttacttctccctcagcttcttgaacgattgcgtattcttccggcagcgcatcaattaagcgaggttcagcaagaatcgtcctttgatatgcgtctcttctgtcagcacctcggcgtgcgcccggctgtcttccgttctgcagccattcaagagtgaattcaatatcgctgatcatgctactgataatctttttgtcgttgatctgttcagccgtcagattgacttcagccgtatctttgtagagccgatacatttttcttgtttctcttaaagctcgtttgtactcaatgattaaatcttgcattctgattcctccctttatttgcgcttaaatgcgccgcccttgcctcgtttaagtgtttgcatgtttgtgttcatcatttgttgccagaaacgatctgagcgctcctgcatgtttttattgggctttttctttttctgcttcatgtcatccctccgttcaaataaaaaacggacaccaatcagagcacagtgattctgtgcaatgatcagtgtccgcaggctttccgtcttggacttattcagttaaagcagcacatatgtagcaatgttcccgatgatcgctactatacaaattgcagttaagtgatttcttagctgtgaatccttatcctctcctataactcccataagagagactatcaggaccagcaagagagctattttaaaggctattaacatctctctcctcctaattaagacccatttgattcattccggatttaacagctagaggcaccacgtccgccggctccacatatggattcttcttgtattcctgatagtaagccacaatcagctttgacgtatggctaacaagctgcagttgtaaaggcatacccttttttaattcatcaacaatcatttgaagttcaatctcagaaaatccgttcatttgtcttccctcttctctatatacttatcaatatcttgaaaaaacgccgcggccgtgaatgcgatgattgcgcctattaacgtgatgtttgctttcatgtccggcctgtattcgtactggaaataaaaccagaaacctaaccccatcagcataaaaactattctcagcgccatcgaatcccccttatttgatttgaaattttgctgattcaaatgttccgatatagttccacttgccggaatcagagtagcagtccagctgaatgacataggtccctttcccggtcttattccggatcgttttcacgttgaatgatttcagaggcgttgccgttttgaagctgcctcgctgtaccagattcgtttcagtaagcccgccgccgctacgcttcttgtatacgccggccgtgtaataaagagtgcttgagccttttttctcggctttccagtccaccgttgaggcgccggccgtgtaagtcgcggcatccgtaaacacccggccgctgtacccggattcattttgccagccggaccatgctgcggaagcagacggcgcaacggccgcggctcccataagtaatacagctgatagaatgattgatttgaatagttttttcattattttccccttcctagttcacaaataattaacatttatttacaaggataatcattattttgctcgaattattactgtgttcaataaaaaacctaaggagtgtttaaaatgaatttcaaaaagactgctgttactgcactagcgattcctgtattagctttttccattagtggtatggcttccgctaaggagataactcctcaaaaaaatgaaacgcaaacaactatatctcctggtccaattaaagcctattacgatacctttgaagtgagagccgggggttctaaacaattagatgccaaatatttaggatcaggattcgcttatcattcagataatagcgctgttttcacagtagataccaatgggcttgtccgtggcaataaagctggaaatgcatatttaactatattcaaaaatggatcagtatacggtcagttacacgtatttgtctattaattttctaatagaagagcattctaatatgctcttctattttccacttcaccacctatgcagcgcccacaatgcgggcagcgggcatctgcgcggatttctaaatcaagttttttataatctcagtccgggcaatgatattcgatcatttactatccgcccattcatcaaagctgtaggggtaatcaacactttcaatgaaaccaatctccttcgccttctgacggattttcatacatccttcatagctgtaagcccatatttctttataatccctcagctcgccgcatttccctgttatgatgaattttctgaagctgttgaccagttgccacatgttgcccccatgcgaaaagccgtttgaactgccgtatcccaattcatacgggtaaacatcagcgcccgtgtaatcatcaacgaagaacagttttttcttaaatctgaaatacgctatgcgatcctttgacttgcggtagaatgtacgatgatcaatgcttgcgataagcttgatcaaatcgtttatgtcgttcattcgtttcaattgctctgctgttggcattgggttccctcctgatcaaataagctgagttgtgtgattttatagttaaatagcaataattcttcagccccgcggctttttccggatccgccgacaacctgtttgtatgcggaaaaggtttctgactcccagttcgggtagatctcgagtatcaaaggatcatcgtaataagaaagaaccactttccctttgacctgattaagcagccgggccagttcccgatgatcctcttcgttaaagccgccagcataaaaccgttcacgcccaacatatggcggatccacataaaacaaagtatccgggctatcgtatttctcgatgatgttacgaaaatccttacattcgatcatgacgcccttcatacggttggcgaaagactcgaaggcagcgcaggcgcttatgtatccgccagcagggttctgcccgctttgtgtgctatgcctccagcctgtctgcggcacttcctccacgttccccttactaatgccggagcgattcatataaaaccacctgacagcccggtcaaaatcattttgcgggtaatcttcagttttccatttctcatagagcgcccggctgtacggaatggattcgcaagcctgctgcatggcctttggatcctttctgacttgcatcaagaaattcaccacatggccgtcaatgtcgttatacacttcatgtcccatttgcggcttattcgctatgacatgagccgcgccgccgaaaggctcgacgtacaccttatgggcgggcattttatttatgatgtgatcggcgtatcgacctttgccgccaaaccagattaacggtgagcgtgccatcccttaacccccgatcaaattcggcagcacggagatagcgaagaagaaaagccccacgcatgccccgaccagccagatatttgttttatcccgtttagcgataatggtatggtcaccgatcattttcagatcgtcagaccgagcgaccagcgtcgggatgtaatccgggtgaacctttaaaagctcggccgcctgctcgacggtcatcgcttcgtccttcgtggccttcacgttccgttgtagttcgacttgtaatggcatcattttgcagcaccgcctaacatttcgggattctgatgtacgttgccgattaactcaccatacatttgaacaaaatcccaacgtattccacccgcataaaatccggcatcatcttctgaccatttaacgactagattaaacacccggccgtgtgatttataacagataatatctcccgcatatatttctttttccataagctttttgcccgtccataaatcgcggctgatcaactcgtaaccaaactcttcacaaaagacgggagacagtttgcgcgccgggcgttcttcaagctgactgatatagtacgttttcaattcaacattgcctgtttccttatgtcggaatacgtatcggatttttatgttattcattccgcagccccctccaatgcttttctggccgtttgccctccgtcgagttcgacagcaggcggacagtcttcaaattcgtttgtatacgtcgtttcattggcgtaaaattctaatgcgtttctataacgcttgttctccgcctgtagcaacttaatatcttcctgagcctgccgaaactgaatgaccgtgacatcctgctggcgctggtgctcccgattcatagcctgttgcatgattaactcttccgcgagcttttcggctgctgcttctaaagatatttgctccggtgtactggccgccgttttcgaaagggtgcaaatgtaagagccggtatataaaacctcaccttttgacaagttgattttgaattctttcatgcccgggcctcccggtctaaaagacatgttttgcatacaacccattgagctgaataatatatttttccgcagcgttcacacttgcgggcaatttcgttttgatacattttccgttcctcccccgcaggggaaaacccctgctaattgaatttatggccgatctcgtaatcacaacgagccaggccgccttttattgtttgaatgattgttttaccgtgttccggggcgtccattagatgagcagtcccttcagtgccatctaaaacgatgatgcggactttccccggctcgatgctttgctgaatagttgtttcatgattttttatttctgtcggcttgttcactctggccgccccctgtgctatgatagaagtaccagttcatatcagagcatcggggccacggcttcggtgcttttttacgttttacgacggcagccgcatcgttactccggcagatggttttaattcctcgcggtaaatgatcggatgcttttcgatgtaagctgccaattgctccggcgtcattttccacttcttaactggaccaggcttgtatcggttgatttcttcttgcatagcgataacctcctgaattgatttagttctcaagcatcaaactttctccacaaagcgttatggcaggatttccgttataatgacttccacccggggctcttcactgtaaaacttgctaactttcagatcgactacctggctatcatcccggtaaatcagatgattcagggcgtctttaactccctttacatagttgtcaacgtccggctttgttacgggacgcaggagacccttttccgcattttctctttttgtcttggaattagaaatttctttcgtcattggtctgaatactctgacatccattgccacaggtcccgtaataacttgttttggccgatactgtgacgccaccagcgcaacatattgtttaaaattctttgatttcaaaggatcacgcattttaaccttgccatttataacagatcccctcggccttccctgtgcaacaggctcgccgtaaactataaactgaatggaatccaaccgtcattacctcccgtcaatttgttcccagtgctgaatctgcttttccttgtacggcgctgtgaggatgatggccggcagcagtataaccgctttaagcactgtgcatcagctccatttgtttgattttttcctcaagcacccggatcgccggggtaaggtcctggccggccgtttgctcagcaggcccgaacacgtacatgccgccggttgctgtgaagttcgctttttccgtcattcccaatctcctaacctatggtttaattgcatccgatcgcccttgatggtcactgtgtaatctctgcacatttgatgaatgcgggagcccagcgcctcgtctatgtccaaaatttcccccgtatcaagctcggaagagattagcagaggcttatgattcaggtaccgataattcacaaccgattgaatttgttccacttgccaatccgtcgcccgcggctccccctttactggtttgaataagtcatcaatgaacagaacttcagctttccgcatagcgtcgagctttgtttccagctgatcaaagtcatttcgcagatcgcccattccctcaacgtacgggaaatacatgcagtaaattgattttttcttaatcaggttgttcatgatcgccgttaacaagtgcgtttttccgctgcccggctgcccgagcaaagcgatactgtttgaacgttttcccttgatgctctgaaaatccttatagtattccaccgcgcactcataagcgtccttgatcatatccggcttcccgtccttaatgaagtttccaaaaaggagcttttcgaattcctccgtgatgccgctggccttcataagccgggcgatctttttccgcttcacacactcgcattgcttggaaaatgtggttttccattctcgggccttatccggcaagcatactttccccgcaagataatcctcttctctgaccatttgatcaggggccaggctttccattgtcttatgctcttttctcaattggcgctcggtgtcttggtgaatacggtaaacaataatgcccttatccttgcagtcagagcactcgtattcagccttttcttctgaggcggcctgtcccgttgaagatgctgctgaccgatcccggagcttggttagaattgccttcattgccgcgtccatatcttgcgttttgcgagcttccatactgctgtttctcctttcgtctctggctgaatgggtttgagaggatggcttcaatgtaattcagattgacgttgttgcccttgaatctgaaagcctgtttcattgcctccatgactttctcttcaccgtaatcatccaccatatatccgagccgctgaacctccatcgtgccaatggtgcgggctgttttgttttcgaatagttcaaatgcgtttttcattttttcgtcaacctcctgctgtcctaaaggtattggagccgggtctatcttcttgttgtaatttccaagctgtatgtactcggcataattcaacaccgtcacaatgaaaccgcgtttttgcggcagccggtccagcttcaaatactcttgctttaccatccgatctaacgagtatttgatctgatcagaagaccagttgaagcgcttggctaaatctacaagcttaatgattgtctgcccgagctttagttcttgatctgccctgtactccgcccgtttgaataaataatcgtatattgtctcgtctcgtgaatctttaaatggcagccggggcaggaccacataccccaaaccttgcatatccatgccgctcacctacttcctttcacacagtgctgtcagagccttgaaatctacttctactaatctcagagacggctcatttgtctttaagtagtcagtcgtgtaccgggtatacaagtcctttctcaagtcgcgctgaaccgttttgaccagccagagataacaatgcgggataggaatcctgatcagctccctttccatcagctcaccaactccgaaaaatggatgatgctgttcagttgattagtggcccggcaatacttgcatttttcgcatcgctctggtttctctccgccgtgtttcacttgcaaaatccgatccatccgctgctcaatctcttcaagctctatttccagcctgccctcatcaatattgatgacagctttatcaggtggatcttcttttgaaacccctacgatcaggggctcaagccattcgctccgtccagtcatccgtttttcaatctctgcgtaaagcgccatctgagcgatgtatccgtatgcctcaacaaaagagcaatatcctatttccgggtcccaaactttctcccgcaatgaccgcgctgttttcagatcggagaaacggccgccagctgggttgtatacgtccagctttcctttccacggaacaccgaacaattcagcagttacgatgacttccttttctccttgaagaacaaacatacagagatcatcattttgaatcgcctcaatcatcagatcagctaactgatactgcttgtacagctggcccttttgtgtaaaaagtgatggggtgttctttttaaattcatcaaaagcctgttcaccctcaagccaggcatgaacgtattggccgaagaggagcgcctccgatgtgggcggcgtccattctccgttcaactttgccatcgtggcagcctcgcattgcaaaaagcttttatattgagaatttgacatgtagtgtctatcaatctcgttagagtaataattcttcttgttcagcgccggtatccgcattagcaggatcacccgccttttctttactatcagcaggcttgtcagcttgctctttcagctttttgaattcttcttcagcctttgatttagtcgcgctagtggccttcacattgaagtaatcctctttctttgccatcccatcacgcagggccgtgtaaatacgaccaattttcaggaaatcttgctcagtgaaggcatcaacattactgccgatgtactcctgaatcatttccttagtgatgccaaactcttttttaaaaagggagaaggcacttctgagtcggtcttccagtggttccttatgtccactaatcaatgttttttgacacatatctaccgccgcatcaacgatgtcgcccggaatcactccaagtatgcaagcacgaacccggcgggctccttgattggcaaccatttcgtaaatatcccttggatcatcaagtttggtaatggcgccccgtgccttccgttcatgcttcacagtgaaaattttggtttgccgggtattcgtttcaagatcccaagcgtaagccatgacagatgattcaccggccttttgttccaactccataattccgtaatcaatgttcccccagttctgtgccaaggcctcagccagccggatggatgggccggaaacctttgtgccgccgcgcggatattcatataccgcattctcagccaatagcctccgctcgcatgcttttttaatccggtcaaaagccgcgtatacgtcccgtgggaatttctttgcgataaccattgccgcttgtacttcttgagcctgtcggcttaccatcgcttccatagtcacgccagtagcctgctggggcgccggcatgtaatctgagtaatccacctgtgataatccattcattgtgcttctgccacctttcttttatatgcttccgttccaagccgctgccattcccgatagtgatccattgaagggaaactaaactgcgctttaccgtttttggagaatacaattgagccgccgacctgccttaaacgtcgctgatcctccgcacgctcactgaatgccactttaactgctttagccatgtataaaacctccattgttttttatggggcgttttggtataataggaatacaatcaattatcaaaacgccttacctagtccactctgccaagtgggcttttttattgctcatttttaaattcaaaaccaagatgctccttcagataccgctcaaggttttccctcaagatgatttcaccctcagcactatctatcacgtaatcatcgaaagccgttacttcatccccaaagtaatccttttgcgtgtccggctcagtcagtttgtcatgccagttgttcaagaccatcggattttcaatattcattgtgaacacctacttacaacactcaggtgaatcccgcgggccgccatatttaagacagtttgatgtaagcgccctttattcgtcagccggtttatatcctctgtaagaaccttgatgctccctgcaagactgatagcttcttcataatcgccatcccgcaacgcctccgcaagcatgatagagagcctttccgccgactcgattttcctttttgctgaatctgcatctgctttaagaaactgattgattttcataccagcaccgcctgcctttcttctgttttcgccattgcaacctgactcattagcgctttccgcgtccacctttcggccagttccttcatgttcagtccatgactacgggccagcgaatatatcagcgttttatttgctgggatcagatcaaaaatctgctttatatcggccatgggcagttcttcaggttgtcggcctggcctatcgtttgccaaccagcgcgctaaatgccttgttgcttgtaatgcttcttcaagctggtgaatcatattgattaccgccgcgcttgcactctcgttaagtgctggatcaattggcgccgccgtcgtcgggtgcaatttgaagagataatgtaccagatcaatatgttcgtatgcctcgcacgcctcaaaccacttaatgcataattccggggtaagcttactgaatccattttcaacgtccgaaacatatcgctgatcctttccccctatcaaattaccgatctgatactgtgcaagtcctgccgctttgcggacactacgcatgatccggggtagattatgcaaattgtatgggttgttctccatatgtttgcctcctgatatatccagttgttcactggtaaaatttaattaatgaagggacaagctagtccttttctcgaacattaatctccccaaatttgtggagattgtttcaagctgtttctgatgaaatgaatttattcacaaaataaatctgaccttttcccgtaacctttggcgttcgggtagttctaattgaaccatcagggttattcattgttctcttcttaatttcaaagagacccaaatccatacttcgctgtgttggtagattgaaagactcgcctgtcttacgaattaaataaccattatcacggagccattgaaataacttgttaggtccaatctttacgccgttctgttgaatgattttcgctaactcgccaacaagcacagatgattcagatgcttccacggcttcggcgaaaagagcttttggcttcatagattcaatttgcttattttgctcctttagtgcgtgaagagttgttttgaaaaataatttggtattttcgtctgcgttggacaaatacgtctgaatgaactgttcatcatttgcgacatatcccccggtttttctgattgtgggtataacttcaaaggctaaccaatcttgaaattgttcggcaatttgattagatgctctaaaagccagcttgtacaccaatggttcaggaataaaatcacctttctctacttctggaaagttatccggaaggtaagtattcacacggctccatcggattgttacgttgccacttttggcaacggtagtgaggcctaagttccgagcaacttgctcggcatcaaaaaggatttgatcattctcaattttggctgcaacttcgaaaatttcatttttgaatgtttgtaaattattcatgccgaagctcctttctgatagtatgcggtgttctcagcaacccaacgcgtgttgctctcaatccatttaaaaagcaaagtcgtagggatttttttgccacattcttcgttaaccggaaaatccggacgggccatcagttccgccattttagtgggaccgcaccgcagcacctccatcgcttcagttctcgtcaagatgtgaggaagctcgttcaaagagctgagccgctctaccagcatgtctgttgctctatcagcaattttggcagctatctgttcaatgaatttctcatcgtattgcatagtgaacatataaaaaacctcctttacaatgagctttataatctctcactttcatgtggtaaaatatgcatggaaggtggtgagatttaatggcttctactaaggtttacgcttgcctttgtggtgaatgggttgacttgactagtgatccggactgcaaaataggtgaatctatgtcttctccatacatatggtgggaagaaggtgcttcaatttggagccctaattctaaagaagagcacacgatgtatcagcaagattacgttaatatttattacaaaaatgctgaatatcgcattcacccaatgtttatccaaatcaagtattcatcctaaattcacgtttaaggttagcttctaacagttctgggtcgtcaaactgcaatttggcggctttagaactgaacagtacatcgacatgttgtttaacacggctccactcggattgggacataccattcaacaaatttttaatttgttccagctttttttgatccataacttcgacctcctatactgtttttttgtaactttcattcctaagcagttttctcgttaccctttttgtgtaacttttcattaaaaaaaagctcatcgacttcttcattcagtaactcggatatttggtgtgctttttcaagacttggctttgtacgccccatttctatatttgcataaccgcttgcgtatctatagccaagcttttttgccataaaagtttgggtctttccttgagaaagtcttgtagcccgtaatttttctagcactattaactcaccaccttactcttttcgtgtaactcgttaaatacataataatatacacaataagggtaagtcaacatatttttattctttttgtgtaagtaattatctcttgtgtgtaaaccgtgttaaaatttacacaccaaataaaaaaaggtgtataataatggataatataacagggaaaatcttaactgaattaagagaaaagaaaggctggagcaaatctttcgtcgcaaaaaaattaggtattaaaacaatgtctacatatgcgaactgggaatacggtttaaggaaaccagatggagaaatgctcgttagacttgcaagtttgtatggtgtaacaactgattatctcctaactggcaaagaacctacttttaataatgacctttttgatgatcctgatctacagatcgcctttagagaagcgagtgacttctcagaagaaagacaaaaacaagcaattgattttataaagtacctcaaagagaaagaagaacgtgaaggccgtaagcctaaaaagtaactaactgccgaaacctttatttatattattgttattatgttatttctgtttactaataagatcaggattggatcgggattagaaccgaactggatcggaaaagaatttttcaccagtaggttgaagccaattatatcaagggaaatagaattctttctcatctggattgcatctggattcaaacgggatctgatcagaaaaaaatatactcaagtgtattacttataaaggggaaattaaatttgtcttttttgatggaaaatggcgaaatctataactgtcagtttaaaaaacgcatgaaggcttctaaaaatttcttgaaaacttatgaagcagctaaacctctgattgatgaaagaaatgaaacaattcatgaactcgtttgcggaactatgaagagtgacgcgacatgggggcattttattgctacagaaaatcaagtatatttcattgtcttgaaaaagaaaaaaccaattttaaagaattggccctataaagaaataattaaaattactgccagtcgcaagccattaattggacataagattgattttaaaacagccgaagaagacttaaacatcaattcaatatcagaaggtgatattgacggctttatcaaatatgttgaatcaaaaatctctggcaatgaggaaagatacgaaagtgaaaaagaggatttaaagaaagaaactaaagaatactattttaaatcagcaaaaacaacaatcacacttgatggaaactatataagagtagcaagaaaaggcgctgttaacactatcacacgagggtatagtggggagaaatcttatagaatcagtgaactgtccgggcttcaaataaaaaaacctggattagtaacctcaggctattttcaatttttaacgccagctgctaatgaaacaagtggactctgggacgcaatacaagacgataactccttcacttttggcgcaaatgaactgcctatggttttagaaattcaaaaatacatagaagaacatcagtctattccagctccaacaataccaccagctcctgcccctactgtatctgcagctgatgaattgaaaaaatataaagaattgttggatatggatgctatcactcaagaagaatatgaaattaaaaagaaacagctattgaatttatgacagcccttcttcctcgggcttttctttcacaccaaaaacagaacatacattccctacatggtggtgtttttaatgtcaatccagttatcgtatcttgaagaagaagtgaaaaaaatctattacaaattaaatattgagactcctgaagacattgatttagaaaggattgccgcggcatttcgtatctggctgcattatgagcaaagagaaagctgcatgtttcaaattaacggtgagtatagcgttgtccttgatgctcgagcctctccgcaagaacagtggcaagactttgttcatgagctagggcatgtgattaaacattgcggaaaccagttcaacatgaatcgtatgtttcgccagttgcaagagtatcaggctaatagctttatgtatcatttctgtgtacctagttttatgcttgaaaagatttcgttgccacgcatgaaatcagaggttataaaattaataggtgatacctttaatgttacatatcaatttgctgctaaacggctcgatatgtatacaagaaaacagttctcattcttgatgtataaacagctctttaaaactattcattgaaaaattggggtgacaaaatgtatacagaggaattgatcaagggtaaaaaatggctggctgttggtgacggacctcgtgatcccgttaccggtaaacgcaaacaaattgcgcggcgtggcaaaacaaaaaaagaagctgaacaaagagttagagatgctattgatgccttaaaagaagatggcattgatgaatcagttgttaaaaaaatgactttcgaaaagcttgctgccgaatggttgaacgaatatgctctcacaggaaagaaaaaagcaactctgcgtattcgaaggaaagaaattaacatcttaaaccggtatatcgctaaaatcaatatcgctcaggtaacaggaagaaaatatcaaaaaatactcaacgatctcactgatcaagaatatgcccgtaccaccattagtggtgtgcatacgacagccggaatgatttttaaatacgctgtaaaggtgaagcttttaaaagataatccagtggctggcgctgtagttcctaaaaagagaatgacagtagaagatattgaaagtagtaaaatagagcaaaaatatcttgaaagggaagaacttgaagagttcctcttagcagtaaaagtccatggtttggaaatggaccttgaacgattttacttgctcgcttttacaggcatgcgttcaggggaaatgtgcgccctcaaacttcctgatataaattttgaaacaaaagagctgcgtatcactaaaaccatatattccgaagataacaatatgagaaattatgaattaactccgccgaaaacagccggatcggtgcgaactatcactctcgacgatcagataatagatatattgaaggcacatgtaaccaaacaaaagaagttgcgcctacagtccaggattgatccaagcgaataccacgacggtaatttcctatttgctcgtgagaatggctatccctttttaccaaaaaatatcattgtaagaatggaaagaatactggaaaaaacatcaattaaaaaacatgctactccccatatatttagacacacgtatatcagcatgctggccgaggcaaaagttgacttgccaactgtaatggaaagagttgggcatgacgacatgaaaacaacgatgaagatttatactcatgtaaccaaaaaaatgaaagaggatgcctcccacaaagtccagcagacttttggaaacatcctcaatttcgggatttcataaagaaatgttatttttttgttattttttcggttaattggggtgatgaaaaacggtcaaacccttggtgtatcaagggttttttccgtttgattacatcatgccgcccataccgcccatgccgcccatgtcaggcattcctgcgccgccggcgttttcttccggtttgtcagcgacaacggcttcagttgttaagagcattgctgctacagaagctgcgttttgcagggctgaacgtgtaacttttgtcgggtcaacgatacctttttcgatcatgtttacccattcgccggttgcagcgttgaagcctacgccgattttttcatttttcaggcgctcaacgatgacagatccttcaagtcctgcattgtgtgcgatttgacggatcggctcttcaagcgcgcgaagcacgatgttgatacctgtttgcgcatcgccttcagcttccactgcagcgactttgttgtatacattgacaagcgctgtaccaccgccggatacgataccttcttcaacagctgcgcgagttgagttgagggcgtcttcgatgcgaagtttacgctctttcagctcagtttcagtcgcagcgccgactttgatgacagctacgccgccggcaagtttcgcaagacgctcttgtaatttttctctgtcgaattcagaagttgtttcttccacttgagcgcggatttggttgacgcgagctgcgattttttcagtgtcgccggcgccttctacgattgttgtgttttctttcgttactacaactttagaagcgcgtcccaattgtccgatttcagtagatttcaggtcaaggcctaagtcttctgtgattacttctccgcctgtaagaacagagatgtcttcaagcattgctttacggcggtcaccgaagccaggagctttaacggcaacagcgttgaatgtgccgcgaagtttgttgacaacgagtgtagcaagagcttcaccttcaacatcttcagcgatcagaagcaatggtttgccttgctgtacaacttgctcaagcacaggaaggatttcttgaatgtttgtgatttttttgtctgtgattaagatgtaaggattgtcaagaaccgcttccatcttatcagagtcagtcaccatgtaaggagacgcatatccgcggtcgaattgcataccttccacaacttcaagctcagttgtgaagcctttagactcttcgattgtgatgacgccgtcgtttcctacgcgctccattgcttcagcgataaggcttccgacttcctcatcagcagcagagatcgcagcaacctgagcgatagactctttgccttcgatcggcttagaaatttcttttaagttttcgattgccacggttacggcttgttccatacctttacgtacgccgacagggttagctcccgcagttacgtttttcaggccttcgcggatcatagcctgcgcaagtacagtcgcagtcgtcgtaccgtcaccggcaacgtcgtttgttttgctggctacttcagctacaagcttcgcacccatgttttcaaacgcgtcttcaagttcaatttcttttgcgattgtcacaccgtcatttgtaattaacggagaaccgaattttttctccagaaccacgttacgtccttttggccctaaagttacttttacagcgtcagcaagcgcatcgacaccgcgaagcatagcgcggcgtgcttcttcactaaacttaatatcttttgccatgttaacgaaacctcctcgaatttttaaaaatatttatttgcttagccgattacagctaaaatgtcgctttcacgtaagattaagtattcagtaccttcgtatttcacttcagtaccggcgtattttgagaagataatgcggtcgccctcttttacttctaaagcaacgcgctctccgctttccaacacgcgacctgaaccggctgccacgattttgccttcttgcggcttttcttttgcagaatccggtaatacgattccgctggcagttttttcttcagattctacgagttcaatgacaacgcgatcacctaatggctttaacaatgtaataacctcctcaatagtatgaatatgtaattttagcactcagctctaaagagtgctaacacagttattataataaagaatctcacttccaatttcaagtcataagaataaaaaattttcacgcttacatgattctctctcgcactgattttctccttttttcacgtcaagttcacttgtgttacaataagaacaaataagttgattttataggataaaggagtacatatcatttgagaaaacagtattggtatatcattttgacatatgttatcatgcagctttccgcattgatcggcattcctttaatgtacaaattcggctatgcgggcgggcaccctacgaatgcgaatctcaccatggctcaggggatttattccgtcgtaagcttttttatctgcctgattatcgttctcttgattttgagaaccgcgccgaaacagacattaagaaacgggaagaaagcatccgccggcatgtccgttctctgggcggtcgcgggaatatggctcgctttattttctcagggaatcgccgggatgattgagcagtatgtctttcatgtgggcagcggttccgaaaacacgaaagccattcttaacattattaaagccatgccgctcatgattatcgtttcttctatcgtcgggccgattcttgaagaaatcattttccggaagatcatcttcggtgtattatatgaaaaaacgaatttctttatcgccggactgatcagttccgtcattttcggcattgtgcatcaagacctcacgcacctgctgctgtatacggccatgggctttacctttgcgttcttgtatgtgcagacgaaacggattattgtgccgatattcgcccatgtcatgatgaataccattgtcgtggtcatgcagctcggccccgcccaaaaatatattgaacagcatagtgagcaaatgcaattaattattggaggattgtttgtatgaggaacccaatgacttggggcttgatttatttcgcagtcggctgtatctttacgtatttggccgcaagctctccgggaagcatgtggtctttttattccatactgctgatggttttcgccgcttataatatcagcatctcgtttaaaatgttcgccttctcatttaaagtgaagaaaaaccaaaaataataaaagaaaagccatttctcatcattgagaaatggctttttttatgctgatacgtcctggtcagattcactgccggtctgccttttccgatacgccgcttttgaaatcaggatactgatctcgtataaaatgcaaagcggaatggtaatcatcaagtgagacagcagctcaggcggcgcaatcatcgcggcgatcacgagcagcacaaaatatgcgtacttcctgatcttcgataaaaacctcggcgtgataacaccgagtctcgttaaaaacatgatcagcaccggcatctgaaacagcagcccgaacggaatcgtcagctgcagcagaaaatgaaagtactcggtaatcccgattacctggttgacatccaggtcattcgagacccgcttcataaaatcaacgaccagcggaaataaaatataataagaaaacgacacaccgccgacaaacagcacgatcgaaatcggaatatagctgagtgttactttgcgctccttctcatacagacccgggctgacaaacgcccaaatctgatagagaataatcggcgaagtcaaaatgatgccgatgataaacgcgaactgcaaaaagataaacagcggatccgtcaggttaaaagcattaagggtgagctcttttacttcatcggctttttgaagatacacaatgataggttttgccagaaaaaagccggcaataaagaaaaccgtaaaggataacgccacaatcagcaatcgtttccgaagttcggcaatatgctccacaagcgtcatttgattcactctcatacgcgtcatcctatcttactgttcttctttctttttttcctcttcttcaccggctaatcccttagtagcgttcttaaattcacgaagcgtgtcccccgccgcttttcctaattcgggaagcttcttcggaccgaaaataatcaccgccaccacaccgataaccgccaggcttccaggaccgatcatgtgcagctcctcctttcgctattcaatttcttccaaaacagaataatgctttaagaaataaaccaatgattgaagctctactgctaaatctatatgatgaattcgaatgtgatccggcacattcaaacgggccggcgtaaagttaaggattcccttgattccgagtgacacgagccggtcggtgattgactgggcggcaaccgccggaacggtaagaatcgccacgggttcatcctttatgtgaagctctaaatcattaagatcaaagacaggcacaccgcctacctcagttcctattttactctgattcacatcaaaagccatagatatttttgtgttattattttttgtgaaattatagtgaagaaacgccgtccctaaatttccgacaccgatcaaaatgacgttcgtcgtttcatcctgatccagtgtttttctgaaaaatgacagcaggtaatccacattatagccgtatccttttttgccgagcgccccgaaataggaaaaatcccggcggatcgtggccgaatcgacttttaccgcatcgctcagttcagccgatgaaacgcgctgctttcctgacgcgtgtaaattctttaaaaagcgataataaagcggcagccgttttgccgtcgcctgtggaatttttgattgatccttgttcatgattggtcctccactttatactcagatgcatctcttttaaaatcaccgtttttgcctcctgttttttccatgaggcaggtcgggccgatgaccattcctttatccagcgccttgcacatgtcatacacggtcaaagcgcagactgaagcggaagttagcgcttccatttccacacctgtactccctttcgtttttacgcttgcctgtatatgaagaacggcttcggaatccttttcctcccagccgaatgaaatgtcgacgctgcttaaagaaagcgggtggcacatcgggataatcgctgacgtctgctttgcggccataattcctgccacctgtgcgacagccagcacgtctccttttccgatctcgcggtttttgattctgctgtacacgtcatgcttcatgtgtacgctggatatcgcagcggcagtacggactgttgaagatttatcgcttatatccaccatgcgggcacggccttcttcattaaaatgagaaaatccattcatatttaaactctccttacttctgatcatacactattttctccctgatgtcttatcctataatgttccaattctgatgtattgtttgctgacagcaggttgataagctacacttaacttattataacagaggtgaaataatatgatgatcttacaaattaatcagctatccaaatcttttggcgctgatcctattttaaacaatataaagcttgaagtcagatctcgggatcgcatcgccatagtaggcagaaacggagccggcaaatcaactctccttaaaattatcgcaggtcacctttcatatgaaaagggtgaattaatcaaaccgaaagaattaacgatgggatatcttgcccagcacacaggcttggaatcccagcttaccataaaagaagaactgctgagcgtttttgatttcctgaaagcaatggaaaaagagatgcgctctattgaagaaaagatggccacggccgccccgcggagcttgaaacgctgatgaaaacctatgacaggcttcagcaggatttcaaggataaaggcggctatcaatatgaagcggacgtccgatctatccttcacggactcggcttcggaaaatttgacgattccgtgaaagtgcaaagcctgagcggcggtcagaaaacaaggcttgcgctcggaaaactgctgctgacccagcctgatctgcttattctggatgaaccgacgaaccatctcgacatcgatacgcttacatggcttgagcattatttacagggatattcaggcgcaatcctgatcgtttcccacgacagatactttcttgataaagtcgtcagccaagtgtacgaggtctcacggacagaaagcaaaaaatacctcggcaactacagcgcctatttagaacaaaaagctgagcagtatgagaaagacctgaagctgtatgaaaaacagcaggacgaaatcgccaagcttcaagattttgtcgaccgcaatctggccagagcttctacaacgaaaagagcccaaagcagacgaaaacagcttgaacggatggacgtcatggcaaagccgctcggggatgagaaatccgccgccttccgttttgacattacaaaacagagcggaaacgacgtcctgcgcgtacaggatctttccatcagctatgacggccagccgccgctcttgaaaaacctgaccttcggcattacaagaggcgaaagcgccgccctcgtcggaccgaacggaatcggcaaatcaaccttgctgaaaacgattatgaatacaatcagtccggaatccgggtcgatcacgtacggttccaatgtcacaatcggctattacgatcaggagcaggctgaactgacatcgtccaaacgcgtgctggacgagctgtgggatgaatatccggacatgccggaaaaagaaatcagaacatgcctcggcaactttctgttcagcggagacgatgtcctgaaaccggtccgttcgttaagcggcggggagaaagcaagagtcgcgcttgccaagctgatgcttcaaaaagcaaactttctcatccttgatgagccgacaaaccaccttgacctggacagtaaagaggtgctggaaaacgccctgatcgactacccgggaacactgttatttgtatcgcatgaccgctactttattaacaggatcgccacaagagtgctggagctgtcacctgatcatgcagaagaatatttgggagactatgattattacaccgagaaaaaagcacagcagctggaactggaagaaatgaagcggcaggaaaaggagcagactcagcctgccggcaaggtcaaacaggatacgaaaagaacttacgaggaagaaaaagaatggaagaagaaagaacggcagcgcctgagacgcattgaagaaatcgaagcggccgtctcatccgccgaagagaaaatcagtgccaatgaggagctgctgtgcgatcctgacgtgtatcaggatcatgaaaaagtacagaccattcacgcggagaatgaagcccagaatcaaaagctcgaaaacttattagcagaatgggaggaactctcctcagaagaatagaaaaagtcaagcacctctttaaggggtgcttttttatccacagctatcctccttgtcagccatttaagtaagcgttttatacacactatccacaaaattttctgactttatccactttactaacaactttcagtcccttatccagactggatttctgaatatattcacaatcctgtggatatgttagaattatctgttaataagtaaaaaaaagcctcacgttttacaacgtgagacgatcaaaggatgttaattccaaaccgggctgtccgttcatatcgtacgagccccggatccccttttcaaaagcaacggttccggcagccgcaatcatcgctgcattgtccgtgcataaagaaagcggcgggatgacaagctcgggatctcccgaatggctgaattcctgctgcagtgcggctctcaaccctttgttagcggctacgccccctgcaagcagcacttgtttaaccctgtattctttcgcggccttagaggtttttgccgtcagtacatcaatgacactctgctgaaagcttgcggcaagatcctccggaggaatcacctcatttttttgcgaggcgttatgaagcgtgttaatcacggctgatttcaggccgctgaagctgaaattgtaagacccttcttccagccacgcacgcggaagcggaatggaatccgttcccgcagcagccagcttatcaatctgcggccctcccggataaggaagccccatcgttcttgccactttgtcgtaagcttcgcctgcggcatcatccagcgtttcaccgataacctcgaatgaaccgtgttctttcatataaaccaattccgtatgtccgcctgacacaaccaaagcaagcgccgggaactgaagctctcctatcagcctgtttgcataaatatggcccgcaatgtgatggacgccgactaacggtatttgatgggcaaagcttaacgcctttgccgcattgaccccgattaacagggctccgacaagtccgggtccttccgttacggcaatcgcatcaagatcatcaaagcccatctccgcctttgaaagagcttcctcaatcacaagggtaatctgctccacatgatgtctggacgctatttcaggcacgaccccgccgaaacgtttatggctttcaatttgagaagcgacaacgtttgaaatgatgtcttttccgttttttacgactgaggccgcagtttcatcacagcttgtttcgattcctaatacataaatatcttgtttttcactcatgtaatgtcacccacattaataacgcatcttccccgttatctgtatagtattgttttctgattcctccggcctgaagaccgaatttcttatataaggattgggcgggatgatttgagaccctgacttcgagagagagccttcttgcctttttttctctgcacaattctatcgcagagcgaaacagcgcttctcccaacgattggccccgatattccggcttaatggctatgttcgtaatctgcgcgtcatctataataatccagattccgcaataccccgccagacagccgtccttttcaatgacaaggtagtgggcatacggattttccaaaagctcatgataaaatgaatccttcgtccacggagaagtaaaggatgctgtttcaatttcataaatttgatcaatatcttccggccgcatgcttcgaatcgccgttttcgttttcatccctatcaccctatttttgagattccatccatttcgcttcagcctctgccagacgcaaataatccggaacaaggctgtggacatccgcttcttctttttccaagcctaaaaacgccagctctgacggccgcggattatgctgtgcagccgttcctatcactgcttgatttgtcagcccatgcagaatggtttcttcatgaatggctgtatcatgccctaaaaataaaaccggagacgctttttctttcagcatgtcgagccaatcagtcaaaagcacattctgatcaggaagaacggattgtaagcggccgtcctgatattcataaagtcccgtatatacctgtccgcgccgggcatcaaataacgggcagatcagtccttgaaagtgccgtccgttagccgccagcacctccaggctcgagacagcggaaaccggaagcttcagcgaccatgccaatgtttttgccagcgtcacaccgattctgacacctgtgtacgatccaggtcctttcgccaccgctattttcgtaaggtcctgcggtgttaggccgcaatccttcagcaatgaattgacagcaggcatcgcccgcacggaatgattcttttttaaatatgtaatatactccgccatcaccgttttctctcgaacgagcgcggcacccagcgtgtaatttgacgtatcaattgccagtattgtcatgtttatttatctcctcacaaagcgtttcataccgtgttccgcaagccgtaaaggtaatgtcccttgcctcatcaccggctctcttgatgacgatctgcagccgttcagcaggcagctgatcctgaattaaatgagcccattcaattaaacagacgccttgtccctcaaaatattcttcaagccctaagtcttcgctttcatcctccatacgatacacgtccatatgatatagaggaatcgaaccgtcatggtattcttttataattgtaaaagtcgggctgtttaccactctcgtgattcccagtccttcggcaaaaccctttgtaaaagtcgtttttcccgcgcctaagtcgccttccagtgtcaaaatgtctcccggctttgccaaagaagcggcaagcttggctacggctttcgtttcttcggggtttttcgttctccattgtaatgtcttcaaagtgagtcacccgtcttatttaaaatgattgtatccttttttctcaaggacgatttgtctctgatcattggctgtcaaaagaacacatgcttccttccgttcagataccgcccctatcttcgcaatcggaatgcccgattgagtgcagtaatcaagcagagaggtccactcttgctgagaaaccgttccaaccaattcaaaatcttcaccgccgaataacacccatttcttccactcagaatctgcctcaggcaaatccggatgcaccggcagaagttgttcttcaatttctatcgtaactgaacttgccgcagctatttcatgcagctcactggccaatccgtcactgatatcattcagagccgcgcgctgaagctgagagcagaagcggccgacttgaactctcggaacgggccgtttatgtttttggataaaataatcactcgtatgaaaagcagaaggatgtgtttctcccaacaaaagagacagtcctgctgcggacgagccgatatcccccgtaacaaacacaacatccccgggtcttgccgagcttcgcagacaagcgcaatccttctcaacttctccgatgacagtaacggtaattacggcttgaccggaagcggagacggtatctcccccgatcaaatccatttgatatagtttcgccagttccgccattccttcatacattgcctggacgtcagctttctgccagcaagaaggaaccgctagagacaccaaataaaacttcggaatgcctcccatcgccgccacgtcactaatgttaacagcaagcgccttataaccgatatcatgaggagaggaatactctaatttaaaatggacattctccaccattgtatcaaggcagacaatttgctgcatgtggggtgacgctgtataaaccgcaccatcatcaccgatccctacatcgacggaaggatgataatgcgaatgcggtgtaatactgtgaatcaaatcaaactcatccatatatctcccgtcttcctttctgacgctcttgtgaaatacagctctttctagtgtatcggattatgtttcaatatccaagactttaacgatataaaagaaagcttggttagataccaagctgccagcattaaaagaaaacacaaaaaaaacgaaaacatgatcgtttcgtttacaataaaaatggcggtccggacgggactcgaacccgcgacctcctgcgtgacaggcaggcattctaaccaactgaactaccggaccatttaatttttggttgcgggggcaggatttgaacctgcgaccttcgggttatgagcccgacgagctaccgaactgctccaccccgcgatgataaaattttagaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaatatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattataatggagcgggtgatgagaatcgaactcacgacatcagcttggaaggctgaggttttaccactaaactacacccgcatttgaattggcgcgcccgagaggagtcgaacccctaaccttttgatccgtagtcaaacgctctatccaattgagctacgggcgcttatcaggcgacttaactatcatactaccaatcagttatgatgtcaagtgttattttatttcttttcgaagtcttttttctcgacctcatttattatacacgctttcgagaatttgtaaagtcttttttaaaaagatcattttctcatttgtcgttatcgctttgttcatcagcgacgtttaataatataccacgcactttaaattaggtcaacacttttacgaaactttttttccgcttattattcccttctatataataaataaaaagcaggattcccaggaaccccgcgtctattcagattacccgctcacctcggcttctgcgctattacgatctgttttttcataggtacggaagttttgttcaagctgttcgagcgaaagacctttcgtttccggaaggaaccttttcacaaatataacggacgctatccctaacaggacaaaaatgaagaaggttgcagacaatccgatgtttgcgagcatgaccggaaaagttaaaccaacaatgaagttcacgatccagaggcagaagacagtcacccccataccaagcccccgcaatcgcagcgggaatatctccgacagcatcagccaggtcaccggagagacagccccctgctgaaacgcaaggaaagtgactgttaatgaaagaaccacataaggaagagcaggcgatcctttcagcacgacagacagaactccgatcaaaagcagcaccgcagtcgttccgatcagccccgtcatcagcatcgggcggcggccgactttgccgagaagccatattcccacaaaagtcgcgagcaccgaaatcacaccgttagcgatattgccgattaatgcggcttttgtctcaaaaccggcatcttttaaaatttgagttccataatacataattgaattcacgccggtgagctgctgcactaccgcaattccgatcccgataaacacaatgcggcgcacccacggaacggcaagatccttaaaggtcgcctgctccatctgagcttccttatgaaaggcagattcaatctcagcgagctcagacttcgctttctcttcattccttattcgccggagaacgtgcaaagcatcttcttttcttcctttagaaaccagccagcgcggactttcaggaactttcagcataccgaaaaacaagaataccgccggaagggccgcgataacgagcatataacgccaagcgtgagaggtatcaccaagcacattgccgatgatagcattacacgtgaaggcaagcagctggcccgttacaatcatcaattcattttgggtaaccattctccctcggctttccgccggcgacatttcagccaaatatgccggaacggttacggatgctcccccgacggcaagccccagcagaaaacgggagatgatcataaccgatacgttaggcgccagtgtacatccaagcgtcgctataaagaacaaaacggcaaggataaggatatttttacgtctgccgttatagtccgacaatctccctccgaaaaccgcgccgatcgcagcgcccaagagcagggagctcgccaccatcccttcagtcaaagcggtaagattaagctggtcagcttccgccataaacggcagcgccccattaatcacaccggtatcgtagccgaaaagaagccccccgaatgtcgatactaaaatgatggttctcaaaaatgaatgctggctgctatttttattcatcttcaaatcctcctagtttttacacagagataatatcggaatattcagttatcaatatttacacctctaacgtctgcatacaaggtctgaccgtccaaaacagttatataagaagaaaatgttccgaaagcgttatcatttatagtgattattcgctctccccctctcgtcatattgttattttatagttactttgtagtgaagttataatgatattattggtacttatgttaatatcataattttaaaagcgctttcagtcaataaatatttcagaaaattttataactcacctttatatcacctatatataatcaattttcgttttatatcaatttatttccataatatactcaattaattacccctattataatcaataattgattacatattgaaaacccccaactgctgattgggggtttttgttttattcttcgtttattgtaacaatcgttctccctctcgcttctccttttaaaagggcaggaagcgtatccggcagctcttcaagtgtaatttccttttgaataaaggcctccagatctgcaggcttgaagtcatcagctaaacgctgccatgttttctttcttgtctccatcggacagaatacggaatcaattcccaagagactgacgccgcgcaatataaacggaaagactgtagccgggagtttcgttcccgctgtcagtccgctcacagcaactgatccgccgtactgaatctgactgagaactgaagcaagcggctcacctccgaccggatcgacggccgctgcccatttttgtttttgcattggttttaacgtgccgttatacacttcgtcgcggtgaatgaccgtctttgctccgaggctcttcaaatacccgctttcttcttcttttcccgtactggcctcgacctcataacctaaggttgaaagaatggagacggcaaagcttccgacgccccctgtcgctcccgtcaccagcacctttcctttttcaggagcggcatggttttcttcaagacgctggacggacaatgcggcagtgaagccggcggttccgatcgtcatggcttctttaagtgtcagaccttcaggcagcggcacgatccaatctgccggaatgcgggccagcccgctatagccgccaaaatgggaaacgcctatgccgtagcttgtcgcaatgactttgtccccttctttaaaacgggcgtcatctgaagaaacgacgattcccgctaaatcaattcccggcacgaaaggatacgaggttacgatcttgccgtcaggaatggcagccaagctgtctttataattcacccctgagtagcaaaccttaatcagcacttcaccctcgggaaggtcctgaaccgccagctcccgtacgctgactgaaaaccggtcttcacgctgatcgactactaacgctttaaattgatctgtcatcactacgtctccttaaaatgaattgaatggctttggaaaagcataaaataagtttgatttgttttcaaatgtcctgccctgtgtagtatgatcaaaagtaaaaacagcgaaagagtggttacgcatcatgtctgataaacaaaacaaagataacaaaaacaacaacagcaatcagccattaccggacattattcataccgccgttttcaaggcgccgatacaagttgtctgggatacggtctctacggcggacggcctgtctctctggtttatgccgaatgatttcacgcctcaagaagacagtgagtttcagctggaatctccgttcggtccgtctccgtgcaagctgctggatattgaagcgccgtaccgcctttctttttcgtgggatacggaaggctggatcgtctcttttgtcttaaaggaaacggaaagcggagatacggaattcactctcattcacggcggatggaaagagccggaagccgtcatcaataaagtcaatcggaaaagctccgagattcacagtacgatggatcaaggatggaacgggcttgtcaacacgaaacttcgcggggcggttgaggcttaacacaaaaggacggacacgctttccgtcctttttttgatgccgatacataaaaactgactttgcaaagacactaacagaagaaccgaaaacttctttcagggggcgctgtttatgtattattacaaagaagagctgatcaatatcattaaaccggacaagccggacccggccgcggccaaggtgcttcaggaaattttaggcgggcattacggggaaatgcggacgatgatgcaatactttttccaaagctctaatttcagaggaaaagaaaagcagttccgcgacctgcttcgcggcgtatttttagaagaaattgcacacgttgagctcgtccagcatacgattaatgcgctgctggatgaaagcggcgctgagggcgccggaaatcaggcagcagatcaggcgccgctagacgaagcggttaaacacgccaatccgcaccattatattatcggggcgcaaagttctcttcctgccgatgcaagcggcaatccatggaacgggtcttgggtatacaaccacgggaatctgatttccgatctattggacaatgtcgtgctggaatcaaccggcgtgctgcaaaagacgcgcatttatgaaatgagctcaaaccagacgttcagagaaacactcggttttctgatcgtccgtgacaacgcccatcaaaatgcatttacaaaagcgctggaaacactgggtgtcgaatggggcaaattatttcccgtgccgaattatgatattgaaaaatacccggaatgccggaaattcgttgaaatgggttatcataatacccaatttaatttcagactggatccgacacggatcggagaaattctgcagggaacgacgccgagccgaaacggcggcgaattaagtgtgtcagagcctcctaaaggtttccccgtgccggaacttcccgagcttccgaatgagcacagccccggactgaaagatatgaacttgtaacaaaaaacgcctgtttcgggcgttttttgtttttctgaatatgaggtttgaatgtgttcaaaacggggaatataagccgggagatcttgccatacggccgtgattttgatgtgagcacatttctgtacatacttcgtttcgaaagttgtcctaattttccagccggccggctgggtatgtttgaatgataatgggaattatgtaaagagaacaatgtcttttttaaggaggcagcgaatgtctaagcaaggaaacttccagaaaactatgtcactttttgatcttattttaatcggcatgggagccatattcggttcggcatggctgtttgccgtcagtaacgtcgcctctaaagcgggcccgtcaggcgttttttcctggctgatcggcgggggaatcatcttattgatcggcttggtttatgcggaactgggcgccgcgctgccgcggaccgggggaattatccggtatcccgtatattcacacggacacctggtcggatatttaatttcctttgtcaccattgtggcatacacgagtcttatttctatagaagtaacggcggtccgccaatacgtggcgtattggtttcccggtttgaccgtaaaaggctctgattctccgacaattgccggatggatattgcaatttgcgctgctctgcctgttcttcctcctcaattactggagtgtcaaaacctttgcgaaagcaaacttcattatttcgatttttaaatatgtcgtaccgattacggtaattgttgtactgatttttcattttcacccgggcaatatgaccgttcacggattcgcgccttttggtttcaccggaattcaggccgcgatttccacaggcggcgtcatgtttgcataccttgggctgcatccgattgtggctgtcgcgagtgaagtgcagaatccgaagcggaacattccgattgcattgattgtttgtattatcgtttctactattatttataccgtgctgcagctcacttttatcggggcgatcccgggggataccctgaagcacggatggccggctatcgggactgaattctcccttccgttcaaagatatcgccgtcttgctcggtttggggtggctggcgacattggtcattttagatgcgattttatcaccgggcggtaacggaaatatctttatgaatacgacttcacgtctcgtctatgcctgggccagaaacggaacattattcagcattttttctaaagtcaataaagaaaccgggacaccgcgtgcctccctttggctttcgttcggtctggctgttttttggacgcttccgttcccttcttggaacgctcttgttaacgtatgctccgtcgcattgattctgtcttatgcgattgcgccgatttcttctgcggcgctgagagtcaacgcaaagaacattaacagaccgttttatttaaaagggatgagcatcatcgggccgctgtcgtttatttttacctcttatattgtatattggtccggatggcgcaccgtatcctggcttctcggttctcaaattgtcatgtttctgatctatctctgtttcagtaaatatgctcccaaagatgatgtcagcatacgccagcagctgaaatcagcatggtggatcgtcggcttttatgtcatgatgctgattttctcctatctcggctcgttcggccacggattgggcattatcagcaatccgcttgacctgattctgatcgccatcggttcgctcggtatttattactgggcaaaatatacaggtctgccgaaggctatgatcgacagtgataaatgacgaatgccggaaagaagtatggtcttctttccggtatttttatgttaagggatgacaaaaaagcgaacatgcgataaaatgaatgacagtcattcataaaaggaggaacccctctattggcaaaacaaagctcgggaaaatacgaaaagatcctgcaagccgcgattgaagtcatttctgaaaaaggattagacaaagcatccatttcagaaatcgtcaaaaaagccggaacggcccaaggtacgttttacttatatttttcttctaaaaacgcactgatatccgcgattgcagaaaacctgctcgacactacgctggacagaataaaagggaaaacggacggttctgaagatttttggacgttgctggacattttggtagatgagacatttcacatcacccggcttcataaagatattatcgttctctgttattccggtcttgccatcgatcattcaatggagaaatgggaagccatttatcagccttattattcctggctggaaggcatgatcaatacggccattgaacagggtgaggtcatcagcggcattcatgtcagatggacggccagaacgattatcaacgttgtcgagaacgcggctgaacggttttatatcggctgtgaacaggatgtcgatctcgaagtatataaaaaagaaatattcagctttctcaaaagaagcttgcagaaatgattggcggagaccgatcatttttgaccgccgtaaaaatgactgacattcattcataactgaggtgactgtatcatgtattggctgcttgtattgatagccggattgttagaagtagtttgggcgtccgccctgaagcatgcggattcgctctttgattggattggtattttccttttgattgccgtcagctttctgatgctgatccgctcttataaaaaaattccgatggctgccgcatataccgtttttgtcggaataggcaccgtcggcacatatgtaacgggcgtcattttaggcgaatcgttttcaatcggacaaatattctttttggctttgctgttgtccggcattttaggaatgaaggtatttacgaaagaaactgaaacaaggggtgaacattaatggcatggctgctgttatttattgccggagcggaggaagttgtagcggccgttgccatgaaacatattgacggttttaaaaaaaagtggccgctgattgtcatggtaacaggctttatgctttcattcttttgcctttccggagcgatgcaggttcttcccacaggtgtcgcgtatgcggcttggaccggcatgggaagcatcggcgtttcggccgtaggcatactttggtttaaagaaaaattcaatctgtcacaattggtgtctctggggcttatcctcatcggtgtcatcggcttaaaactgacagcgtaacggcctgagacagctttttaaataaaaaacaaaggaccctaaacgggtcctttgtttttttatgctgttttgatctgttccgcttttcccgctccgactccgaaaatgaaaatcagaacagagactgcgatcagcatgaataacggaaccgtccagccgtgcgtgatgtcatgcagcaaaccgaatacaagcggcccgaacgcggcaagcaggtatccgaatgactgggccatgccggaaagcgccgcggcttcatgaacatgccgggtccgcaggctgaagaacatcatcgccagactgaacgcacagcctcccgcaattccgatcaaaatgacccatagcggagtgagagccgggcttccgaaaagaacgccggcaatgccgataaggaaaaataaagccgtcagtccggcgagtgcgcgctgatttttcattttagcggcagcgatcggcacgataaaagtaatcggcaggactgagaattgcattaatgaaagcatccatcccgccttacttgagctgagtccattctgctgaagaatttccggcagccaagcgatgacggtgtaaaaaataagggattgcagccccatgaacatcgttaccttccaagccagcggagaccgcatcagactgttttttttctctccgtttgtcccagtcgtgcggacgggcagttcgcgtcctcgcatttgcggaatccacatgacgaacgcaataaaagaaaggatagcccagcagccgagcgcgcctttccagcctacccccgctgaagaggcgatcggcacgctgatgccggatgcaatcgcgccgcacagattcatagaaaccgagtagacgccggtcatgatgcctaaatttccgggaaacttatgtttaatgagactcggcagcaggacgttgcatacggcgatcgacaatcccaacaggatcgttccgaaaaagagagtgccgattccggcgatggagcgcagcagagttccggctgtcaggacaattaatgatgacagtaagacaatctcggtcccgaagcgccgggacaataaaggaacaaacggcgacagacatgcaaaggccaaaagcggcactgtcgtaatggtgccggcagccgcattggtcatgccgaggctgtcccgaattgaggaaacgagcggtccgaccgatgtcagaggcgctctgaggttggcccctatcaatatgactccgatgaccagcaatatcagttttttacgctgacttgcttgcagaacttgatgttcgtctttaattttcatgttcatcctccatgtgtattgtatctttaaatactgtgatgtattggttgacggcctccatggcctgatccggtttctgtccgataatcgcggcggcaagctgggtgtggatccggatagcaggggtgatttccaacaggttatggactgacgcacaaagcgcctccgtcatatgctcgtatagatcagaaagcatattgttatgggccgcctgtacaattgttttgtgcagcttaatgtcggcttcggcataccgttttcgatcttcattttgcaaggccgcttcacattcatccaagcatgccttcagtgctttcaggtcttcgtcattacgcctttccgccgccaatcgtgcagcttctctttcgagtgcgtatctgacttctaatgtttcaagcaaatttgattttttaatatggcggtaaaatgccgcgccgagaacactggatgagctgacatacgtaccgctcccctgccttgtctgcagcaggccggcatgtacgagcgcccgaatggcctcacgcaacgtgtttcggctcacatcaaattgcttcattaaatccagctcagggggaatgcgcgtcccgaccggccatttatccgattgaattaacgattcaatttgcgccaccacttgttctacgagcgacagtctgcttgttttggatatctccatcaaaacacctctgaaatttgtaggatgattctatcattgggtaatataacataaaagaagcgacgatgtaaatcagcggcaacaaaaaaagagtgagtttttctctcactcttcggcgcttttatgaacgttttatattgactgaggtcacgacaaacttgtcatgacggtggcgggaaaatgaatattcaaagggagtgccgttgtccaaaaagcctacatgctcgacttcaagtatcgggtcatccggccggcagccgagatattgctgatccatatcatccgacttgcacgctctgatttttctgtgtgtgcccgcgattttgagctgcaatccccgcgtaatatgatcgtagatggaatggttgagcacctcgtcattaatgccgggtataaggctcgccggcatgtacgttttttcaagaacgtacggttcgccttcaacgattctgagcctcactacataatagacgggagtcttttcatcgatagccaaatgtgcggcgacatcttgagacggaaactgcacttcaaaccggatgaccttgctcttgatatttttgccttttaacaaattgctcaagccgagaatttcgttgctgactacgtgaacgtgctcatcctgcatggctgattgaatgataaatgtgccgtgccctctttttctgaaaagcatcccttcagccgcaagtgtatcaagcgcccgcttcatcgtcatccggctgcacccgaactccgcagcgagcgtcttttcatccgggatcggctgatctatgtcatatacactgcttttaatcctctttctcatttcgttggcgattttttcgtacttattcatcggtttcctccggctgtgtaatgtttgatctgtatagactccttacggttatcataaatttttttccctgcttcatcaatgacgttacagccgccgatattgaaattgaaaggatttcctcgaattttctatggaatctccctcactattatggtagaattttttgcagaaacggacacaaccgaatattgcaatatattgtataacctcaatgatatggtttgagggtgtctaccaggaaccgtaaaatcctgattacaaaaattgtcccgtacactttttgtaatcaggattttttattttctaaaaaataaaaaaaggagtatctgtacatgaatttcaaagtatttctgcttgcagcatctaccatcgcagtcggattggttgaattaattgtgggcggtattcttccgcaaatcgcttccgacttagatatatccattgtcagcgcggggcagctgatcagcgtgtttgcgctcggttacgcggtatccggcccgctgcttttggcagtgacggcaaaggctgaacgaaagcggctttatttaatcgcactgtttattttcttcctaagtaatctggtcgcttatttcagtcccaatttcgccgttcttatggtgtcacgggtgctcgcttccatgagcacagggctgattgtcgtcctttctttaacgattgctcctaaaatcgtggcgcctgaatacagagcgcgggcgatcggcatcattttcatggggttcagctccgcaatcgctttaggcgtgcctgtcggcattatcatcagcaatgccttcggatggcgtgttctgttcttgggaatcggcgtattatctctcatttccatgctgattatcagcgtctttttcgaaaaaatacctgctgaaaaaatgattccgtttcgtgagcagatcaagacgatcgggaccgccaaaattgccagcgcacaccttgtcaccttgtttacattggcggggcattacacactctatgcctactttgcgccttttttggaaagaacgcttcatttgagttccgtttgggtcagtgtatgctactttttgttcggtctgtcagcggtatgcggcggcccgttcggaggctggctgtatgaccgtttaggagcatttaaaagcatcatgcttgtgaccgtttctttcgctctgatcctgtttattcttccgctgacaacggtttctttaatcattttcctgcctgcgatggtgatctggggattgctcagctggagccttgcgccggcgcagcaaagctatttaatcaaaattgcgcctgagtcttccgatattcagcaaagcttcaacacgtccgctttgcagatcggcatcgcgctcgggtcagccatcggcggcggcgtgatcggacaaaccggttctgtcacagcaacagcctggtgcggcggtttgattgtcattatcgctgtcgcgttagctgtattctctttaacgagacctgccttgaaaagaaaatccgcataaatgtgagaccgcaaaaaagccaaaggagttccttcggctttggcggtctttttattttgcggcagcaagctcgtcttctgtcacccatttatgattggttactttttggccgccgtcagtcggtgtatagtcgaccatataaacggttgtctttttggctgaatcaataacggcttcggcacccttcatgcctttcatatgggatgcctcgatcacggccttgtcacccggttttaacgttttatcaccggcgcccttcagctcttcctgaatgacccatttgtgatcttcgacgcgctttcctcccgtttccggagtgtaagatacactgtaaaccgttgtatcataagcaccttttacggttccttgcgcatttttcatgcctttcatatgagaagctaaaatcatgacgtcactgccgactttataagtcggattttcggctttctttaaacctttcggcacctcggatgaacctgagtgattcatgtcttcgtgagagtgcgtttctttgtctttcgctttttcgcttcctcctgaagattgaccgttgcatccggcaagcgccagaacggggatcaggagaaacatgctgaataaaaatagtctcgctttcatttcaagaactcctttgcctttttgatttttcattttccctttcgtttcttcggtaaaacaaaaagatggcctgtcatttctcctaattcttcaactctctctttattgccttttatcaggtgaaattgttcacaaaatgtacacattaatagagatgcagtataatttaattatcagataatagggggaactcatcatgaaaacgaaggtttttgcggtggtattgggcgctgttttaatgattgcggggttggttttggcagaagtttcgctttatatggaatacatcacaatggtcggagctatgattttttcttctatatttatgtcagagccgaaaagaaaatttcgcgtcattaaaggggtttgacttttctattaccgccgtcttctcaggacggcggttttgttttgcatgtcagtcagtctatccgcaaagccgtttcttctgtgccgtcctgatataaaacgaaatgcggggcagtttgtgctttatcacctgcaaattcaatttcaagcggcagcgccctgacaaaataacgggtttccgtcattgggaataattcaaatggtgtctgcccgtctattgcaagatacaatcggttttcttttaccgtcaccgatgcatgtgtgtcatcctgaaatgagtaattgccggtaaatctgctgtaaatcgcaggatcgatatctgcttttttctgatccgccggacgtttcggaatcacgtacggctgatcaaataagatgtttacggccgcggcaatcacagcttgttcaaattgatacgattgttccatattgctgagataaatcagtgttttgttctggtcaatataccggatcatcagagttgaataacccggccagcctccgtcgtgactgataaccttccctttttgggcgctgttttgaatcatccagccaaatccgtatccgaattgctcttcttcattccaatagcccggtgtaaacgcttgatctttagactctttgccgatgatttcttccttataaagagcctgatcaaacagatataaatctctaatagtggagttaacggttccgtcaccttgaatcccgtcaagaaagacgacataatcggtttcctcaagttcatccggcagcacatattctccggaatgaacatcatacacatagccatatgcatagtttggaatgttttctttactcagccttctgttataaatccgcgtatcgtgcatacgaagcggatgaaatacggcttgtttcataaattcagcaaaactcatgcctgatacaatttctataataaccgctaacaccgcataccccgtattactgtatagccactccttgcccggcgggaaataagcatccggtttatgctgcttaagcatatcgatcacatcttgattaacggcaattctgtcccggtcccaatgtgttaaaaataactccatatagtccggcaatcctgacgtatgatggagtaaatgccgaatggtaatgcccggataaggaaaatcaggaagccaccgctctatcatatcgtcataacgcagcttccctcgctgctctaaaatgataacgcctaaagctgtaaacggcttcgatactgaggccaattcaaagactgattggtcattcagcatcctctttgttttcagttctgcagcgccgaatgaaccctgatataagatgcggccgttttccgctgccaatacagctccgtttatttcatgtctttcgtctaaagtgctgaaaagctgttcaaaagcttgttttttcttatcgttcatttcacgaacctccatatacaagctgatttactcttttatacgaacagccgctttagaagtttcaatattttcccttcccggaacaccagtcagtaaactgccgttcaggcagccgcggaggtttaatgaaggtcttttattcgcacaacactgtgcaggcttcgaactcaacatgcttctcgtctttttttgcgccggcaatttccatagtcgaaaacatcgcacagatgacggctttgtattcgttcatgacggtttgaatttcaatcagaaaccgttcggatgaagaggcgtattccgttacgtattctttcattttgccgataatatcatctgcctgacggatgaagccggccgcctccaagtcactctcaaactggtttttgttgatcatatgaatatgcatttttcaaggcccctttcagcagcgttttatggttatatccactgtaaaggacaggcttggataaacttttaataaaatatgaacaaaatatgaattggctcatcggcctgaccggcgggctttcggctgtgctccgtttcatttggactacctgaaataatgacttctttactctatgaaaaacagctcatatatgatctaataccagtaaaatgaacgttaggaggcggcctatgtcagcagcaggaaatcggcaaaaattttgggtcatggcgatgcttatagcggtctttgccgtgtttgttttctctttttccgagaatcattcacaaaagaactggcacacggcggttgaccaggcgtcagtgaatgtcttcggccagcagatctttgaaaaagaccgtctggcaaaaacactcaacgcacgtgaggcagaatctcttctgactcttgtgaaacttgcaaatgaagaacatcacatcatctaaaagccattataaaaagcctgtttccctttggcagaggaaacaggctttttccatgtattattgagcatgtttttgttcaataaaccggtcgatccgggccagaacatcctgcatgtccatacattctttaaagctttcattaatggcttgaatgccttgtttgtattttccgttatgcagcacttcttccgcggcaagctttaccttttcagcgctcacttcatctttttgcactgtacagcctgcatccaattcagtcaggcggcgcgcaaccatcggctggtctttatcatgcggaataacgaccagcggcacttgataatgaatgccttcatttacactgttcattccgccatgcgtgacaaacacgtcggcctgctccagcacttcaagctgcggcacgtacggggcgatgataaagttttccggcgcctgtttgattttcgacagatcggctttttccccggcggcaatgactacttttccttcaaaatctgagaacgcgtctatgcacagattgaaaaacgcttccgtgtccccgagcaccgttcccattgagatataaatgactttttcattctttaatgagtcaatcgggaagtcgacgcgcccttttctcttcggaaaactcggaccgataaataaatactcatctccgaatgtctcactttcgggctgaaaatatctgcttgtatagacgacgttcaattcacctgtgttgttcataaattgaaccatgctgtcaggggcgacaccgtatttgtctttcatctcggccaacagctcttcacattccctgtccggctgaaacggcacgcccgattccggatggagcggcagtattttcagacggtcttcattgaacaggaaggatgctgaagaagagatgccgggaatgttgagataatcccgcaccaactctcccgcaccaaatttatcataatagacggcgtcgaattgaatgtcctctgccagccgctgcacaatatgtaaaatctccagtgacgttttgatatgaacctttaaaaatgcaagtatgccggacggactgccgggatcaatgggtgtcattctgagcagatcgctgtgaagatgaactttcgctcctactccttccagtctgcttttgtatttttccgttgagatataatgaacgtgatcgccccgttcgctgaaggcctttgtcatacccaaagtcgggtttacgtgtccttctgcgggaaaattgatcatcagaatatgtttcgccatttttcaaactcctttgccttttttgcgtctcttccatatccatcataaatgacgcggaaaaaatcatgcaaggaacattcgtcaggtctttatgacggttcgatgacatcggcaaaaaaagacaaggcttttcaccttgtctatcgtgatgattcgtctgtttcacccgctttgagcacacctttcagatgttcttcatcatgcttgagatgctccgtcatatattgcacggcttttgttttatcgcccttttttatttcttcaaagactttccggtgctcatgcaggataacctccgcacggtcatctcctttaaaattaagaactctgcaaaaatgaatcagcacattgacatgctcaagcagcatggccagccggctgttgcggctgaaatccacaaggagccgatgaaacgactcgtttaaggaaataatctcagtctctttgacgcctttattgatggcttcttccgtctcccgcagctgtttttcaatgaggtcaatttcactctcagccgcttcatcaataaccagttcgaccgccaatgattcaagtgacattctgatttgataaatctcttcaacatccttaacggacaaagaataaatgacaaagccgtttcgatcgtctgccgtcagaagcccgtccttttcaaggagccgcatggcttctctgaccggcgaccggctgactccgaaatccttcgccagctgagtctcattcagccgttcacccggtttaaaaatcccgtcaaatatcatttttttcaattgggaataaaactgcagataatacgggattggcttatctaatttaaaattatccatctttcctacctcttcatacaatttaggccttattgttaccaagatcatataacagtttatctatggaagcaacattccagagcttgtcagcataacggaggtgccgtaatatggaagtatagttggtcgagggtattccgtaaaccgaaaacaattcattcggaggtgacggaaacatgaagacatactagattgccggcataccgggggacggtgtggggaaagaagtcgttccgcaagcggagcgggtgttgaacgcgatcgccgaattacatggaggcattgcctttgatttcacttcttttccgcggagctgcgagtattatttggagcacgggactatgatgccggatgatggattagaaacgttacagcactttgatgctttgtttttgggagcggtggggaatcaaaaactcgtccccgatcatgtttcgctgtgggggctgcccatcaagatacgccggtaactacatctccgattttgatctgtaaacgtccgggaaggtgagtacagctctgtcggcagcagcatctatcagggtgaagatgaaatcgccattcaatacgcggtcctttcccggcggggtacggaatgagtgatctgttttcgaaccggcagcgttcggctggggttttgacaaagaaatgatacaattttttacagagatagagagagaaaattgtatgtcaaatcgcagcaggggaactgcaaggaaacggtaacccctcctttaattgtggtgaaaaaagaggatacacctacaagacaggtcgattaagatggtctattggcatcttacatccgcaaatatgtctttacacaaaaaagttagagaggtaaaaaatatgaaaaaaatattttacttttttttgatattatatataattatagtattattacttaattctgtatttgacttaagtaatgtattattaactgttttgtttgctatattcgttggtgcattagtgatttatagcattgcgaaacggagtaaaggtgatgagagaaaaaagtgttaaagaaggttactaaattatttatagcggggtgtattctcgctactgtgttgtctgctttcgctccaagttctgaagcagcttgtcgacggacaaatcttgggactcagtgtgataatgatgttcttcttaaaaaaagggtaaaggtttattacacaaaaaatcaggtgaaaaaagtggtttctagatataacagcatggggtctaataaagggcttattctcggttatattattgggttggtacacccttctactggtttaagtgttttaatgtatcaagtaggagctaataatatgattaagccttttaaaactgctaattctaagaaaaagggtttagagatttcttacacggttaccgtttataagtggtcaaatgcatctactaaggtatctggagtaaaatataaatatagataagactaagtaatacataatgagcaggcgatggcctgcttttttttattacaggagaaatgtgcaaaatgaaaaaggaaaactgaagtggaaatcgatctgcatgtcagggagcctgtgtgatgatgcgttcccagagtgagtcaacagtatgcggattgcagggaggattaaggagttgactcactcagtcagcattcaaacaaacttgtttcaatcggcggaaacacgtcacaagcgcgacgaaatcaaacggtattgttcactcgatgccgttctgggatgacatctttaaagaggtcagccgggagtacgccgggatcgagacggattcccagcacatcgatgcactggcggccttctttgtcacgcagcccgaacgctttgatgtcattgtcgcttcgaatctgttcggagatgtgctgacagatatcggcgcggcgattatgggaagcgtcggaatcgctcccgcagccaacatcaatgtaaacggcaaatatccttccatgtttgagcctgttcacggctccgccccggatattgtcggaaaaggaatagccaatcctatcggccaaatatggacggcgaaattaatgctcgattcattcggagaagaggaactgggccatctcctcttacaatctattgaaacggtcacaaacagcggtattctgactcctgatgccggcggaaaacattcaacggaagatgtcacttccgctattatttctcaaatcaagaacagataatacgaaaaaaccgcgggcaggaaaactgcacagcggttttttcgtctcagacgggacggagcgcgcagaaacaggccgattcacctgtgaagcccgcaatacggcctgattgatccttttctacagaaaaaaaccgctgtatatcacaaggagcatccagcatctgtttttccagtaatgcggctttctcttcagtcaggcttgcccgttcacaccagacggtaaattgaaatggtttcaaaaagcagacagcggattcaatccggaagccggctgtctccagaaaacgaagccattctgtttttttccacgcccgaaagtggctctgatcccgtttcttttcaatgtcattataaaaatggtcatattcatccttttcaggtgcggtattgtcaatgagaagcagtctgccgcccggtttgacaacccgaaacgcttcatgaacaaaggctctgacatcgggaaaatgatgcgccgcgattctgcatgtgacgatatcgaaagcagcatcggaaaacggcatcttttcagcatcgcctttttcgaatgacacgttcgtccatccgtttccggttataaatgcttcagcggctgctaacatttcttccgtgaggtcatatgcgataacagagcgtacgagaggagcgagagcgttagccgtatgtccgcctcccgtcgcgatatccagcacgtccatatgcttttcggcaccggaagctgaaatgagatatgccaaatcctctcctgcggcgtatccgggactagtcacatatttcgcggcgtttttagcaaattgccgctgcgcctgctgtttaattgaatcctccattatacttgggcccccttttctttctgcttgctgccttaatcaaaataaacgggttcgtccggatgtttgagatatgcaaacatcttttcaatctgactttccgtattgcgggcttcagatagcggcggcagttccgtttccgcaaaaaagccggccgcgcttgtttccgttccctccctgagccggccgccgatgatctcgcatcggataaacactttgtaaacgtgggcggcggacggcgggtgggaatggcatttcttatccattacagctaacagtttaacgggctttacgtcgattcccgactcctcttttacttctttgacagcggtctcgcccggtgaaatcccgatatcagcccatccgcccggcagcgcccatctgccgtcgcttttctctcttaccattaatatgctctgatctttaaaaactgccgctctgatatcaactttcggagtgggatagcccgtgtcaccggcgaatacgtctttgatgatgcttttgtcgatgccggtatgttgcgccatgatatccacgcttatttttcttatttcttcaaatctctcaatatcatatatgtctttggaataagccagccccgcttgcgccgcggattgaagctgttttgcccattcaagccattttggctccattttttccaccgcccgttatgttaattaaacgaaacccgaattgcaccttgagagtaccccgtttctgctccttgttttctgtttatggcggagcgaatcctgccgggaaatcagaaaaagccattcatttgctgaatggctttttttcattttctatttttctttcatgacgagaacgacgcctgaaacaataagggccgccccgatccagaaggttcctccgatcgtctctcccagcagcagccagccgagcaatgtcccggaaagcggctgaaagaagaaaaacagaccgccgcttgccgcattcagcaattgtaatccgcgattccaaagcatgaacgcgcaggcggttgagatcacacccagatataaaagtccgccccatatctcaggccgggcaagctgagacaaaggaatctcccgaagcgggccctctgtaaacggggtcaggatgacaaatgcgacgcaaatggaatacgttgtgacgacaagcggtgagtaatggccgggaacccgtttcatcagcacggacatcaaagcccatgtcagcgccccagccagaagcgagagaccgccgaactggctcgacatattgagatctccgttccccacaatgagcaatactccgatcgtcgccagccctgtcgatattccttttttcagcgttaaccgttctttcaaaatcagccgggcaaatacaaccataaatgcgggagtggatgccgtaataatcgcacccatctgcgcggttgataatttcgtgccgatttcctgcgtgacgatcgaaatcgtgttgccgatcaatccgatcgcagcgatcagtaataaatcacgtttatgaactttccaggattggcgtgtaaataaactgagaatcaaaagcgaaaaaagcgccaccgcatatctcagccataccagttcaagcggcggaatgaccgctaccactactttaacgacgacatacataccgccccagatactggcggccaatgccaaataaatcgaaccgaacaatgtatttttcaatttgatgcaccctccgttatcatattaggtcacgtcatatgccttaacggagagaagcgcagtcactttcctccattaagggcggagaagtgctgccggtacatcatgttcaaataagggcgctagaaacatatcgtttttcacctcaattgcaatctgatttttctcattatacaaggtttgtcagaagacgtaaacgaacggcggcatcggctttatcgattgcggacttgcagctggattcttgtgatctgattgtcaaacccgtccgccacaacctcatcaagcaaatattcttcatatgcataatcgcccatttccagcccatactcttcaataaactgcatgatgctgcggtaagccgcttccgcttcatcccctatttggtacccgacggcataaagccctttcggcttgatatggaggtcattattctctatgccttcttctgtcttcatataaaaatgggtgtagttgtagaattcttttttcagaatctgctcccgcgcaaacagtccgccgaccggatgcccctgatcgagttcatgtacccgcatatagcggatcaattcggaaatggccgcagtgtattgccgttctggcaaatggagtacgggtcgtcctatcataagtgtctcttcatctaatcgctgcaatgagacggaggagaagtctgtctccaaagcttgttcggtcagcttcacctttgtctgaatcattctttgcaggtgctccagctttttgattttgctttcgatttctgatgatttctcttttaaaagcgtgatgataccctcaggggttttgtctgttaagagcggtttgatctgcttcaagggcacgccgacctccttaaacagaccgataacctggaacagttcgaattgatgataggaatagtatctgtatccgttcgcttttttgatttccggagaaagcaggccgatttcgtcataatggaacagggtttgtttttttacgtggcacagttttgcaaattcacccgttgtgaagtattttctgacgtcttcgctcataatgcctccttgactatacggtaaccatatcctttatgatgatcattgtatccgagagaaggctgattcacaaatggcttacgcaatgaaagctttaccgtctcagaaaaagcagaagaggagtatcaagtatgacgattgaaatcagagcagtcacggaagaaaaccgtgctgatatactggcgcttcatgtaagggaaagccagacttcatttattgaaaccgcggaagagtgcttacaagatgctgaggattgccggcattatcagccggccggtctttatgttaacggggaattagtcggctttgccatgtacggatggtttccggaatatgatgaggaaaatgaaaacggcagagtgtggcttgaccgtttttttattgatgaacgttatcagggacgtggattgggcaggctgttgcttgatgcccttatccgccatctcgttcgaatatatgagtgcagacggatttatttaagtctgtttgaagataacgtgcacgcattgcggctttatcaaaaattcggcttcttattcaatggagagctggactcaaacggggaaaaagtgatggtgaaagagctgtaaaccctctgtataaaagcgattcggcttcttgccaatccctcaaatttgaggtaacataaagataatggacgacggtcgacggacgacgatcgattgttaaaaacctgataaagcggatctgaacatggtgatcaggcatctaaatggaggagaagattgtgcttattatactcgttatgttccttctcgggattattctagggtttatcggcgcggggggagccggttttgtcattgcacttttaactatactgtttcacgtaccgattcatacggctttgggcacctccctcgccggaatggctttcacaagtttatcgggggctttcagccactaccgtgaaggcaatattcagatgaaaatcggcctcatcgtcggcgtttttgcggcattcggttcgtttttcggggcaaggcttacttcccttatccctgcagatttgctgcattacttgacggcgggcatgctgtttttatccgctctgcttattttagtccggttatttattgtaaaagaaacacatgaagattccggacggcaaagcaatctgaacatatgggtgaaagccgttgtactcggtatcatcgcaggaatcttgtccggaacgttcgggatcggctctgcccctttcatccagatcggcttaatgattcttttgcgcttatccatccgccagtcggtcggcaccaccatgcttgtcattatcccgcttgcggtcggcggaggactcggttatgtgacggaaggatttgtcgattatatactgttggtcaaagtgctgatcggcacgatgtgcggcgcatatgtcggagcgaaattcaccaaccacgtgccgaaagtcattctgaaatcagccatctttttaacaccggccatcgccggtctcatgcttttattttaaactgaaacgggaggcggccgcctcccgttttttctgttcttcacctgttttcgaagagctttttcagctttgcttccgtttcggtatgatctaccggcgtatacacactgcagcgcagatcactgttgccctgaacctgaaatgaagtcaggttaaagaccatttttcccgccttcgcgtggcggaactcaattaatacttcgggtgccgagctgacttcgctctcattccacagcgtatgaaattccgaatacgttttctccatttcttctataaactgagaataccacgtatcagctacatactggccgtagtacgttctgaaaatggcgatgaatcctttcacaaagtgctcccagttcacagctaaacttcttaattcttttctggaaaacaatagctctatgagattccgtttttcaggaggaatttgttcaaaatctaaaaacacgtgagccgcggcctgattccatcccacgatatgacagcgcctgtccgagataatggtgggacaataacggagctcctgcaggatttttgaaagcgacgggctgataaccgcttcttcctccgcggcaaacggctgcttcacgccctcctcaatggcaagcgcgtataaataatttctctcatctttgttgagctgcagcgcatcggaaaccgcgtccaatacggctgcggacactttaatgtctctgccctgctccagccacgtataccacgtggtgcttacgcctgctaattgcgcgacctcttctcttcggagcccgggcgttcttctccgtgtgcccatcggcagcccggccatctgcggagaaattttggcccgctgcgtttttaaaaactctgagagcgcctgcaatcttccttctggtatcataccgaatctctcctctcttaccctggtattcattatactaggataatcaacaacttgtaataggataattgcgagttacaataaatacataccgaaggaggaatgaccatgaaaagagttgtgatcaccggaatgggagtgatttcacctctcggcaatgatgtgcatacattttggaaacacctgacggaaggaacatcgggaatttctctcatcgattcgtttgatgtctccggctccaagacaaaaatagccggcaccgtccgtgattttgacgcagaagaaagatggggcagaaaagaagcgagacggcttgaccgtttcagccagtttgctttagcggcagcggaacaggcgcttgaaagctccgggattcagctcgatcagattgaccgtgaacgcctcggcgtgtacgtcggctcgggaatcggcggcatcacgactttgattgataacgttcatactttaaatgaacggggagcgcgaaaagtgagcccgagccttgtccccatgatgatctcaaacgcggccgccgctcaaatcagcatcagattaggcgcgctcggcccctcactttctcccgtcaccgcgtgttccatcggcaatacgtcgatcggggaagcattcaacgccattcggaatgatgacgcagatattatgtttgccgggggagcggaagcggcgattacgaatttgtcattagccagcttcggcaatgcccacgcgctgtcagcgagaaacgaagaccccgccgcggcaagccggccgtttgacgctgatcgcgatgggtttgtcatgagtgaaggcgcgggcatcttagtattggaatcattggatagcgcaatcggcagaaacgccccgatcctctgtgaggtgctcggctacggcgcaagctctgacgcgtatcatatggtggcctcccatccggaagggacgggcgcatacctggcgatgaaaaatgctttgaaaaaggcgaacgtttcagcggaagacattgatgtcgtaagcgcccacgcgacaagcacaaaagccggagatctttctgaaacattggcaatcaaaacattattcggggagcttgcgtatgacattccggttacggccaacaaatcaatgctcggccacatgcttggcgcggcaggcggcgttgaagccatcgctctgacagaaagcctgagacacggcatcatcccgccgacgatcaatctgcagcaccctgattcggcatgtgatttggactatgtgtcagacgggccccgccatcaatcgttaacgatcggcctttccaactcattcggctttggcggacataattcggcgatcgtgctgaagaaatatgaatagcgggcatcaaaaaaaggagtgaatcatttcactccttttttgctttctccggttttgttgttaaggcaaaaaaagcgatggaaccgataacggatgtcgtgaacataattgcccccatcggcacggccgtcgcttcattcatccccacaagcggcgacacgatggaaccgagaagaagcggaagcatgccgagcagtgcgcttgcgcttcccgcgcggtgtccctgcttttccatcgccaatgtaaaggtgcttgtcagcgtcatgccgatcgtaatcatataaataaaaatggaaatcaccagtgccgccagcggtccgtgaatgatcgtcatgacgagcagaacggcagtcgccgtcatcgctgtaatcacgccgattttcagcaggcttttttcgtgaatgatcccgccgaaacggccgatgataaagcttccggtaatgatcgccagaccgtttatgccgaataaaacactgaatacctgaggcgatactccgtaaatatcctgatacacgaaaggcgttccggagacatacgcaaagctcccgccgtgaataaaaccgaccgtcagcgcatagccgataaatgaccgatccttcagcaggcttcccattgtccgcacggaatttccgatggagctcggaatccgcttttccggcggcagggtttctgtcagcttgagcgcaatgatgagaacaagcaaaaacccgataaaggttaaaaacagaaaaatcgtatgccatgatgcaaacggaagcaataaaatcgcgcctcccgtcatcggcgccaccatcggcgcgacggcggtaatgaccatcagcagcgagaaaaatttagaaagttctcttcccgtaaacacatctctgacgattgcacgggataaaacgagtcccgccgaagcggtgaatccttgaagaaaacgggcaatcaccagtgttgaaatgttcggtgcaagcgcgcaaaacagagaaaacaaagcaaataaaaaaatacatagcaataacggttttcttcttcccttcgcgtcacttaacgggccgacaacaacctgtccgattgtcagtccgatcagacaagcggttaaactgagctggacaagcgaagcgcgggcgcttaaatcttcggcgatttcagggaaactcggcagatacatatctatattgagcggccccagtatcgcaagcattccgagaagaaaagccagcgcaagccgctccttaccggtcggattatgcagcatatcgttcccacctttcctttgtcaatctctcaaaacatttgtatattgtatcataattttttctttatttttaaaagttttcaaagggcataaaaaaaaccaagggctgtaacagcccttggttccgggtcacgcggtaaaaggttttacgcgtgtttttctttaaatgcttttgcgtattgatcagccgctataatggcgtccgccacgtcgtcagccgtcacgtcaaaagcggcatgaatcgtttcttcttcaatcgtcgcggcttctgccactttcataatgtcctctttagatgcgtctttcattttgatgtcttcaagtgtgacaggcagccccaagctgatataaaacgcgatataccgctcaatttcctcaagcgaacgtttttccagcgccaattgaacgagcgtgccgaatgccactttttcaccatgggtcaagtgatggatttcaccttcaagcgcggtaaatccgttatgaatggcatgtgccgcagctaagccgccgctttcaaatcccagtccgctcagaagtgtattggcttcaaccaccgcttccaatgcgggcgtaacggctttcgctttcacagactcataagcgagacggccgtatttgaataataccgcttcacatttttccgcgatagcctctccggcgattgtcggaattccgcctgccatcgttttaccgccattggcgatgacactgcgcgcctctatccacgtcgccatcgcatcggcaatccctgatgctaaaaagcgcggcggagcttccgcgacgattttcgtatcgaccagaaccaagtcaggattcttatgataaaaacgatagttttcgaacgcgccttgttcagaatacacgacagacagcccgcttgtcggagcatccgttgaagcggccgtcggcacgataacggtgtagccgtttatttcatctgatacggctttggccgtatcaagcgttttaccgccgccgactccgatgacaatagtcgcccctgctttttctgcgatgccggcaattcttttcatttcttcctgggaggcttcgccgttgaaaaccgcctcttcagaagagatattgcttttctttaattcagccgtcaccttgtggcccgcgatatcccatacggttttgtccgcgatgacgacggctttttcaccaacgccctccagatgtccgccgatcgtttcaatggcgttttttccctgcacgtatttggccggactgataaaaattcgttccaatgtcatcatcccttcttcgttgtctctcattacatttctcttattgatagagcggaaatgaaaactcttctgatataattcctcgttttaacttggtttaaacctcatatacactgcagaaaatcaattttcacggcattgacaagatgtgaaggtgtctatataatcttcgatattgaagctgatcattctttactgaatgaacaaacgagattgtgaatgattcgtcttaaaaattatttagttctgctggataatttttgaggcgtttttgttttatatatatttttgactgcggaggaggtttgcacatgaagaacatttgcaaggatatactgatgattatggccggagcctttcttatcgcggcgtccgtggaatttttcgtcatcccgaatcatttaggggacggcagcaccgtgggaatcgctctcgttttatattatcttttccatatacctgcaagtattacgactctggttgtaaatttgatttttatcgggctggcttataaatttttaacgaaaaaaacgattttatacacgatactcggtacgggaatgacttctgtttttctcagcatcgtcagctttattccgttcggcgtgcacgacatggtgctcgggattgtattcggcgctctgctgatgggagcggggctggcattgatctttatcgctgacggatctaccggcgggaccacgcttttggcgtatttattgaattacacaaagggctttaacatctccaaaagcatgttttatatggattgtgtcatcattttcgcatccgttttagcgatcggaatcaatcatatgctgtatacgtttatattcgtttatctgtgcgccaaaatcgtcgatattgtcattgagggtttccataataaaaaagccctcaccattatgtctgaccaatacgaagaaatcgccaaagccatcacctccgagtacggcaacgcggcgacgattttttacggatacgggtattacggcagcaaagacaagcgcattatctatgttgtcattaaaaagaacgaattgctgaaaatcaaaaaacatgttcaaaaaattgatccgaaatcatttatcgttattcatgaagtaaaagaagctgtcggagggcaattcgggtttacaaacctgcccgccgccgcaaatgaaaaataaccgcctgcagtgtatagctgcaggctttttttattcggctcttccccgctcaaaggttttttacatctttcaatcgaagtagtaaatgaaaccttttttgatggaggaacataaaaaaatgaatatcaaaactgaaaggctcgtcattcggacatttgaaccggaagattggcaggatgtctatgcgtacacctcgaatccgagtgtcatgaaatatataccagagggtgtctttaccgaagaagatgccaggaaattcgttactgaaaacagcggtgaacatgccgggaagtttcccgttttattgaaggatgagaaaacggtcattggccacattgttttttttcagtattttggcgatcatacgtatgaaatcggctgggtgtttcacccggaataccagggcaaaggatatgcttcagaggcggcgcgcgccgtgctggcattcgggtttaacaagatgaaattacaccggatcattgcgacatgtcagccggaaaacatggcttcgcaccgggtgatggaaaagatcgggatgaggcgggaaggcttgtttaaaaaatgcatcccccatgataatgaatggtgggatgaatattattatgccgttttagaagaagagtgggaagcctccgatctggaataaaaaggcttataccctttgcttttacagataagtgtgtgctacactgttcgtaacaaatacgaagggatgatgggtggacaatgattaactaatcttattttgaccgtttgaaatcaaatatttcaaatcagaaaaaataggattagtctgcccattttctatacgatacgagaaagctatgtaaaaatagcttatttgatcacgcacaggtacggctaatccttccaaatcaattgggaggattttttgtcctccctttaaagcgagggattgacatatgaaagaaatgttaaaaataagcggcatcagttacgaaatcaacagcgttcccctttttgaacagatcagcgcgagtgttcagcaaggcgacatcatcggtgttatcggtaaaaacggcgccggcaaatctttattgctgcaattgatctgcaataaaaaagcgccgtcacaaggacagatccagatgatgcaagatgtgaacatatatatggtggaacaagaaacggaagcttatgattccggccatccggagcctgcggaggcagccttgttagaaaagtggaacgtgcccgcacgcgccttttcgcaattaagcggcggagaaaaattgaaagcccgtcttgccaaaggtttctcctcctcaagcggccttttgttattagatgagccgacgaaccacctcgatcagcacagtttagaaatactgcttaatcagatcaagaattacaaaggcaccattattttcgtttcacatgatcgtgcttttatagatgcggcggcgacaaaaatctgggccatcgaaggaaagaaactcattgaacataaagggaattattcaagctatatggaggtccgcaaacagagaaggctgacacagcagcgggaatatgagaatcagcagcatatgatcagacggattgaagctcaaatgaacgagctgagcgcctggtcaaaaaaagcccacgcccaatcaacgaaaatagaaggctttaaagaatatcaccgcgtaaaagcaaaacgcacggacgcccagattaaatcaaagcagaagcgtcttgaaaaagagcttgaaaaagcgaaagcagaaccggttgaagcggagtatgaagtccgtttttccattgagcaccgcaaaaaagcgggaaagcgttttttagaagtaagtgatgtcacaaagtcatatgaaggccgaacgctttttaaaaacgtgaatttcactgtgatgcacggtgaaaagatcgcgattacaggcccgaacggcagcgggaaaacaacattattgaaggtcatcctcggtcaggaaaaagcgcagggcggcatatggatttctccgtctgcaaacgtcggctatttaacccaggaagtattcgaccttccgcttgataaaacccccgaacagcttttttacaaagaaacgttcgaagcaaggggaaatgttcaatccctcatgaagcatttaggatttaccgcagcgcaatggacggaacccatcggcaagatgagcatgggagagcgggtcaaatgcaagctgatggcgtttattctgggggagaaagatgtgctgattctggatgagccgacaaaccaccttgatctgccgtcacgcgagcagcttgaagacactttggcccgatacgacggaacgctcatcatcgtatcgcatgatcgttactttgtcgaaaagacgacggacatccggcttgatatctcaaacggcagcgtccgaaaacaatggaaagaatctccctccgtcagggatgatgctgaagaactgcgattaaagtttgaaaccgaacggcaggaagtcctcggaaaactcagcttcatgactccggctgataaacaatatcgtgagcttgatcaaaagttcaaagagctgacggaagaaatcaagaagttgaaatgaatgtaaaaacccgtgattgtcacgggttttgttttggaaagttcacgtattatgaagaataatttcaaactgatttgtacaacctacgttcagattcatacgagaaggttcagaaagaaaggttcaggtgaacgcagaatggccaaacgcatcggaattacgggaaacattatggctgatcaatccggccctttcccgggttataatcgggcatatgtcaataatgattatattcagtctgtttctgaggccggcggtgtgccgtttatattgccggtgattcaagagacggcgcttttaaaggaacaggtctctcatgttgacggcatcattctgtccggcggccaggatatagacccgctgttttacggcgaagaacctttacaggctttaagaaagacctttcctgatcgggacgcctacgaaaaggagctgattctcacggcggttgctttagaaaagccgatactggccatctgccgggggatgcatatgttaaacgttacttacgggggaactttatatcaagacctggcacacgcttcgtttgctgacattaagcatgaccaagaaaaagatccgccgttaaaaacccatcatgtttcttttgaaaaagggacacgtctccataccttgtttggcgattcagcgcgggtgaattcattccatcaccagatcataaaagagacggcgccttcatttaaagccgcggcttatgcgaaagacggggccattgaagcgattgaacgaacgggtgaattatttgtcgtcggcgtgcaatggcatcccgaaatgctgacaaaaaaacatgaagacatgaaaaagcttttttctctgttcatgaatgcggtcagcacataaaaaaagcagatcataacgatctgctttttcattttattcttccggtttctccggtgttttgccttgtgtcagcttatggccttcgatatccacgttcggaatgattttatccagccacttcggcaagtaccaggccgcatgtcccatcagcttcatgacactcggaatgatggtcattcttacaatgaacgcatcgaaaagaacaccgaaggtcattgccaaccccatggatttgatcgtagagtcccccgcgaagatgaatcccgcaaagacgaaaatcatgatcagtcccgccgctgttacgacaggtccgctatgtttcaatccggcatggatggcttgtaccggattttttgttttgacatattcttctctcattctgctgacaaggaatacttgatagtccatcgccagcccgaaaagaataccgatggctaaaataggcaggaaggcgagaatcggacctttttccggaatgctgagcaagccggtgaaattcccatcctgcagaacgaataccgataacccgagtgtagcggtcatcgtcagcaaaaagccgacgacggcggcaagcggcacgagaagcgagcggaaaacaacggtcagcaatacaaacgcaaacccgacaataagaatggcgaatttcggaatcgcatcgtttaaccggtctgaaatatcaatattcaccgctgttgacccggtgacgagcaggcggatgccgtttttgtctgatcgtttccgtatatcctgcactaactctttcgttgccttatcattcggcccggtttcaggcactgccgtaatgatggcataatcccctttttgattcggcatggcaggtgtgacgctcgccacattgtgcaagtcctttatttctttcacggcgtcttgaaatgcttcacttttattccccttgactccttttgcatcggcaacaattgtcagcttgccgttaaagccttcgccgaatcctttagacaacagatcataggcgcggcggtccgggctgtctttcgctttcattcccgcatcaggcagccccagttctaaatgcatggccggcagactgatgacagctaaaagaataatgctgaaaatgcttaacagaataggcttctttgtaacgaagcgtccccaggcattcgtgtcggcgctttccttttctttcttcttgtttgatttcggaatcatccgttttcctgcgattgacaacaccgcaggaaccagcgttactgatgccaatacagccatcagcacactgagtgccgcagtcaatcccatcgcagacatgaacggaatgccgacaacggtcaatccgcaaagcgcgacgatcacggtcagtcccgcaaaaacgacggcgctgccagccgttcccgcagctttagcgatcgattcatttttttgtacaccttcgcccaaaaactgacgatgcttcgtaaagataaacagcgcataatcaatcccgacggccaggccgatcattcctgataatgagagactgaccgaggctatcgtaaagatctgtgtcccaattaacgtcagcgcgacgcttacacctaacccgatcagggccgtgacaatcggcagccccgctatgactaatgaaccaaacgtaatggccagaacgacgaaagccagcacaacgccgacaatttcagatacaccgccggcttcaacaccggcccccggcacatcgccgctgagctccgtctgcaggcccttgtctccggcggcggacagactgtgtttaatatgtgaaacagacgcatccgtaatgtcatccgccgcttttttgtacgtaatatcggcatatgccactgacccgtctttagaaatggttcctgtttcaaaaggatttgcaatcgaagcgaccgaatgatctgttttgatcttctttaatgtctcttcaatcgcttgtttttccggttttgacgtcaatttcttcctgtcttcagctccgaaaataacccgtatgcttcctttatcgggcccctttgaaaattctttttgaatcacatccatcgccttttcagaaggtgtgtcgggaattgacatatcctcagaaaaagcaggttttaacgagatggcgatcacaatcgaagcgatcagtatcacgagccacgcactgatcattttgaatcggttgcgggcagaccatccccctaatttatataaaaaaccagacatcgaatactcctctccaatcattactttctgcctaattgtagttcacattcacataaaaaaaacgtacataggggcatgtacgtttgggcagtttttcattatatattcagtttcagaatgcctttttgcatagcaatggtgacggcttccgtccgcgaatcagcgcctaatttgttataaatcgatgttaatctcgcttttaccgtccgctctgagattcctaaatcgaaggcgatcgctttgcttttatgtcctttcgcaacggcttgcagaactatgatttccttgtccgtcagctgtgtttcattggcatttgcccgttccattttcttttcccggaaacgccgcaagatgtccggctgcagaagcacttctcccctgaccgccgcatccatcgtatgaaataaggtttctgagcttgtgtccttcagcagataaccgttcgcgcctgattcgatgccttctatcatcagatgatcttcattataggtcgtcaaaataataatcggcacatcagaatgctcttttatctgtttaatggcttccagcccgctcatttccggcatgtacagatccatgagaatgacatcgggctttagttccgctgcgaggcggacggcggttttcccgttttccgcctctcccgttatggtgtaatggtcatttgtttctatcaaaagcttcagaccttctctgacgacaagatggtcatctgctattaacactttatacatgttccgcttctccttgaattggtatgatgatctcaatttgagttcccgctgatctggcgcttgttatacggaaagtgccgttcatcatattgacgcgttcttgtatccccagcagcccgtaatgtccgctttttctcatttctgttccggcatcaaagcctttcccgtcatctttgacggttatgcggatctgtccctcttcttcctgaacggacacccagacattctttgcttctgcatgcttggcggcgttagtcaggccttctccgatcatgtaatggcaattctccgccgtatgaacgtcaagcacatgatgcacgctgtaatctaaaaaacaagacagcccggaggcttctgtaaaatggttgatttgttcagtgatgctttcttttaagaacccgatctcttctgatttgctgcgaaggttgtcaatggccgagcgcgcatcagccaatgtgcccttcactctgtccattgactggctgatgatgtctttcgctctgtcagtgttaccctttgaaagatgaacatgcaccgcttcaagctgcatatgcaagctgaccagcccttgtgcaagtgtatcgtgcaagtctctcgccatccgctgcctttcgttttgaagcgtcagctgtttcacttgccggtgagcgagctctaatttttcaagcgtcatctgtgttttgattttttcatcaacttgcgcgaaaaatgttgccgcatatgtgataatcacgatcatgatgggagcggcgataacgatgaaacgaagcagatgatgcggatgctcctggtgcagggctgctatggacattaaaatgaaaagatagagtatgagcggcgttttgcccttatccgccattccgataatctgcccgattaaaaaggcatagagaccgatgaccgccgcgatatagccgccggtcatcaagttagccgatgtatatatgataaatccctgtatgatgaaataaagaaacgtttttttcttgacccagcgataggaatgccagtgcagcacagcaaaaatgacgatcaatatcgtgaataacagcagcaataaaaccgtccagctttcataaatgtactgcaaagagactgatgcggcatataccataaaaataaacgccagaccgggcacccgaagcgcaagcatatgcaatgagcgtctgtcacgggagacatagtcttcttgatgttttgtaccaaacaatctctgtccacttccttttagccgaccggcctcacgatgttttattctatttgtcatcataccataatcgcctgcttctcaccttccccttctgtcctgcttgacgggtgaaagaaaaaacagcctgcgggattgttcgcgggctgcttttgttcatatcttttttatgacctttcccgggtttcagcggtctgtctcccgcgcggcaaaaccgcccgcgcatcagaaaaacgttcaggacaccgacagccattccatgtgaacaagaggaagcgattgtgcttcctcttttttaatgtaccgtcaaatttcttctctctttttttataaacaaaatttgtaagactagagctcttttctcaggggaaattaattatgtaattgagaagaggaggtttaaaaaacgattatggaaaagcgtgaattagcggctcacgagtcgctggacttacatgaaatcattaacttcaagacgctttgtgtagcgaaatccaagctcatgcaagggcttgtgtttgatcaggatctgaaaacgttaatggaaaaagacgttcagcaagcctcgcaaaaccttgctgatctgcaggcggtttatgaacgggcaacgtttcaggctcctgttcctcaaaaccggccgacttcgatcatcaattgaaaggaaggtaagcatcattgaaccatgaccatttagatccaatcaattcattacacgtccctgaactcgcagatatgacattcgcaatggattttctcatacgcgcaaaagaaggcgtcagaaataccgccgttgctttaacagaaaccgcctcgccagatgtaagagctttgctgcgcaaacagctcatgcaaggaatcgcgatgcatcaggaaattacagacttgatggtcagcaaaaagtggtttcacccgcatgatctgagcgaacagtataaactggaccagctctctgcgaaaaataccctcatggtcggaaacatgaatctgtttcccgttgaaacgaacagaaaagggatgtttgaccgcacacctgatgaacactaacactggaggtattacagcatgaaggccgtaacgtatcaaggagtgaaaaacgtcgtcgtcaaagacgtgcctgatccgaagattgaaaaacacgatgacatgattataaaagtcacaagtacggcaatttgcggatcagatttacatttaatccacggactcattccgaacttgcaggaagactatattatcgggcatgaaccgatgggcattgtggaagaaaccggtcccggcgtgacgaaagtcaaaaaaggcgaccgcgtcattattccttttaatatcgcctgcggagaatgcacttattgtaaaaatcacctggaaagccaatgtgatcaatcaaatgaaaacggcgatatgggcgcttatttcggctattcagggagtaccggcggctatccgggcggccaggccgaatatttgcgcgtcccttttgcgaactttacccattttaaagtccccgaaacatgcgaagaaccggatgagaaattgagtgttattgccgatgcgatgacaaccggtttttggagcgttgacaatgccggcgtaaaagcaggcgatacggtcatcgttctcggctgcgggcccgtgggccttttcgctcaaaaattctgctggttaaagggtgcgaaacgcgtcatagccgtagactatgtcaactaccgtctccagcatgcgaaacggacgaataaagtggaaatcgtgaacttcgaagaccacgaaaatacgggcagctacctgaaggaaatcaccaaaggcggcgccgacgttgtcattgacgccgtcggcatggacggaaaaatgacagatcttgagttcctcgccagcggattaaaacttcaaggcggggccatgagcgcattggtcatcgcgtcccaagcggtgcgaaaaggcggaacgatccagattacgggtgtgtacggcggcagatacaacggatttccccttggcgatatcatgcagcggaacgtcaatatccgatcaggacaagctccggttatccattatatgccgtatatgtttgaactggtgtcaaccggcaaaattgatccgggtgatgttgtaagccatgtcattccgctcagtgaagcgaagcacggctatgagatgtttgacacgaaaacagatgattgtattaaagttgtactcaaaccttagagaacggaggctacagaaatggccagcgccttacatgaattactcgaaattcaggagatggcttcttttaagtcactttgcctgacgaaatccaaaaccatgaaagcgctcgtatccgatccgcagctgaaagaaatcatgcagcaggatgcggatacatcaacaaggcaattgcaggaatttgcctcgattttatctgatgcaaagcacgaataggagatgaatgacgaatgaatccgattattgaatacctgacggggatggatgcactgacagaccaaattgtcgctatggatttattgaattcggcaaaaagcggagtcagaaactatgcgatggcggcgacggaagccggaacgcctgaagtgaaagcgatcctcacccgtcacttagaagaagccatcgacatgcatgagcaaatctcacgctatatgatggaaaaaggctggtatcatccgtggaacacagatgaacaagtccggtttaatttgcaaaatattgatacggcgctccgcctgcccgtcctataaatgttttcctgctgagacagcacctctggctcagcttcagtatgtcaaactgagaactgcctttacagcgcccaggcaacgaaactcccgcgaatcagctctgcagcttctccagcctttcttcgggctgttattggggcttgcggcggtgattacgtgcgtggcggccgccgggcggttcgcaaatagagcgaagaaggcagaacaatttgttctgccttttcattattttctgccccataggcacaaatacttttcacccgattcgagcggcggttattcacgtagcttgaactcccttaaacgcactcatcacaagatcatgcacataggaatcattcacctcatcacctgtgatcaacaggcgatagaaaatcggtccgtaaatgagatcgatgcttacgtcaatatcaagattctctcttaattcacctttctgaattcccttttccagaaggcctttcgcttggaggcggcggggctggaaaaatcgcgtgcgatattcttccgccaattttgcatccagctgtcccgcaccgattaattccttaataacggttccttcccggctcgtcaaaaaccttgctaaattcgcggcgtgggtcaatatatcttgcactgttgatcctgtatcgggcacaggcagtctgtccgtagcggtcgaaagaaagctgtccatgataacggcagccttgtttgaccaccatttataaatcgttgccttactcactttggcacgctctgcaattttatcgactgtcaccgcgtcaaagccattttccaacaataggtcataggcagcagaaagaatcgccttatgtgttccttcatcacgcggccgtcctcgtttactctgcacatgaatcattccttcccgaattataaacgatacgttcagtatacttaacctgtataaaaaaagaaaacagaaacccatttacaaaactgaacgtttagtatattattcacttataaacaaaactgaacgtttagtttataaaataacttgagggaagtcttgatgaaatgcagactccaaaagcctctgcgtaaaggagatgaatcagcaaaatatttatcaaacctcataaaatcattaaaaaggagttcattcatatggctaaagaaaataaacaaacagcggatcaggggatttcaactggtttaacccttcttctcgcaacggcatgcggtatcattgtcgctaatctttattatgcacagcccttggcaggattcattagtgcggcaatcgggctttctccaagcagtgccggattgattgtcacgctgactcaaatcggatacgttgccggcctactgtttctcgtccctttgggagatattatcgaaaacagaaaacttgtcgtggtatcgctcctactaagcgcagccgctctaactctgacagcatgtgtgaagcatggaacactgtttttagccgctgcgtttttcatcggactgggatccatcgcggcccaagtgctagttccgttcgcatcataccttgcaccagatgccgcacgcggccgggttgtcggcaatgtgatgagcggcctgcttctcggtattatgctttcccgtccgatatccagtctggtcgctgatatatgggggtggaatgccatatttgctttatccgccgcgttaagtgttgtcctggcaatcgtcttatcaaaagtgcttcctgccagaaaaccaacagcaaacacaagctacaccgtcttactcggttcaatgtggaagctgctgcgcacgactccggtcttacgccgccgtgccatttatcatgcgtttgtatttggagctttcagcttattctggacgactgtacctttactattgtccggtcctgcttttcatttttctcaaaaggcaatcgcgctgtacgcattagcgggcattgcgggtgcagcggctgcaccgataggcggccgtctggctgatcgcggcttaacccggcttgccaccggaatcgctctcggtgttgtcatcgtttctttattactcccgctcatgattcagagcagctctcccgtcggaatagcagttctggtggccgcagctatcctgttggatatgggggtatctgccaatctcgtactcagtcagcgtgccattttttcgttggcacctgaattccgcagccgattaaacggattatttatggcaatcttctttctgggcggcgctataggatcatcaatcggaggatgggcatacgcctcaggcgggtggagtatcacattatggattggaatcgcttttccggtcatagcattgctttatttcaccacggagaaataagcctttcaccaaaaataagccgtcaggaccaagctgacagctttttttggggtgtattcttctttacatccatccgaacaaaacatccggattcatgaaaagatgatattgattctttacgccccgctcatatagacgggcgcatgcccgctgccgattctttcagcagcggtaaaaccatgtcataatatgtttagaaataattgtccataggcaggtgaaacacatgaagaagtatttatataaacaccttttgttagctctcgtttcgtccgtttgctttttattggtcttttatgtgggtttaaaaatgacacaggaagacacacccccgttgtcttcttacccgttttacctttttatttatctttacatagcagccggatatttgacggtcggccttgtttcagcctgtatgactgatatcttgaaaaaccgctggacattgaataaaacgtcttccattctattgaaacttatcgtttacttactcataccgtatgctatttttcattctttcttcattttaatggcgccgttgatttatgtgctgttcgagtcgttattcatcctgagaaaagcttcataatcagaaaaaaacataccgcatgctgccggtatgtttttaacatgcttgtcagttttttgcggtgattcgtttgatgttttcttccatcaagccggaaatgagctgttcgtttgtatgaggaatctgtttgagctgttgtacgaccagcccttgtcttgcggctgaatgattttgactcagctttgcctgtccctctattttgctgattttgattttaaaaccttttacccctttgttcatgcctgccagcaatttcgcatcgacatcctctaatttgtacgggctgtcggggctttcgtatttcaatacgagatcactcatcgactgcacggtttcttcctcatccaaaagctccgcctctccgtaaacatgaaccgccacataattccatgtgggaacagcctgattcgtctcataccatttaggcgagatataacaatgaggcccctgaaaaacggctaatacgttttggccatcaatctctttccattggggattcggcaatgcaaaatgaccgtataagcattcgttattcttactcatcatcaatggcaggtgggttgcatacggcatgccccccgccgttgaaaacaatgctgcgaaaccatactctttgattacatcgcacgcttcagcttcactcagctgaaatggagccggaatatacatacaaaactctcctctctgaacatggattgataaagcgctttccgctataataaaatatcaactgacatttaaaaagatacagtttcaaataaatacacatgtcagaggagaacatctgatgaaaaatttgattttcgctttcagaagcggcaccccgaaatacaaacaaatttacgagcaatttaaaacattgattgagcaaggaaatattcaggcagatgagcggctgccttccattcgcgagctggcggattccctgcgggtaagccgcaatacaacgctgatggcctatgatctgcttttagcggagggatacattcgcggagaaacacgcaaaggatattttgctaatgaaatagaaccctctttatttcaacaagaacatgatgttgtttacgctgagaaaaccgaatcaactcagccggccctgattgattttcgcgccggagccgtcgatcaaaagcattttcctctgaaaacatggagaaaattatacaatcaagttttggcatcagagaaaagctttctgtacggtgaaccgttcggcgagagaaacctgcgtgaacaaattgccgcttatctcttggaatcacgcggagtgaaaacagatgcggattcggttatcatcggcagcagcacccagcagatgctgatatatctcagccagattctgaaagaggatttttccggaattatcgttgaagaccctgggtttgacggtgccagagcggcatttcaatttcacgggctatctctggaaacgatgcctgtctatgaaaacggagctgatttttctcaattgcatgcaatgaaagaaaaattaatctatgtgaccccatcccatcacagcccttacggcgtaagcatgtccattcagcagcgccaaacactgatcaattgggtgaatcatagagagggttatattcttgaagatgattatgacagtgaattccgttatacacagcagccgtttcccgctcttgcttccattcaatcagaccgggtgatttatttagggaatttctcaaaatcctttctaccgggcatccgcataagctatatggttttgccgcagcgccttttgcaccggtataaaaaacggtttattcatttcgaaagcaccgcttcttcgcttaaccagctgaccatggctgaattgatgaaggccggtgaatggacccgccatattaagcgcatgcgcactgtctacaagcgtaagatgcagcacttgacttcacatatcaagcagcagttcggcgatcaggtgacgatcatcggcgagcagtcgggattgtatatattagtaagagttcacctgaactatacagaagaaacattaatcgaacgcgcctttcagtacggagtgaaagtataccctaccgctgtctatttcgttgccggaaagcccgaaccgccgatcataaagttaggtttcgcccatctcgatacggatcagatcacacaaggcgtacagcttttgagaaatgcttggctgtcatgaaagaaaaaaggcgccgaacggcgcctttttttatcttttatttcgtatttcttgggaatttcggcagtccaaatataatggcggcgatgccgcagattccgattaaaacgggatagaaagagtatggcaggatgctgacgggtgaaatattcccgaatttcccggctgataacagctgcgcgccgtaaggaatcaatccttgtatcatacacgaaaagatatccagaatacttgccgattttctgttgtcgatgttgaatttatcagcaatattctttgcaatcggcccggctgcgataatcgagatcgtattattggccgcagccagattcgtcacgctgaccaatccggcaatgccggcttcggcgccttttttggaacggattcgtttcgtgatgaactccagtaaaaagtcgatcccgccgttttgtttcatcacaccgaccattccgccgatcagcatggacaggatgataaggtcgctcattccggcaactccatccgtaatcgctttaaaataagaatcaaacgtcaggctcccgcccgccaatccgatgattcccgtcaaaaccaatccgccgaatatgacagccatcacattaataccgattaacgcaaaaactaacacggcgacataaggaagcaccttaatccagctgtaagatgcagcatccgtatggagggcgtggcctgccggaataaaaaataagataataacagtcacaatggcagcgggcaaaacaatcagaaagttcgttttgaatttatccctcatttgtgttttttgcgtccggactgccgcaatggtcgtatctgaaataaaagaaagattatctccgaacatagctccgccgaccacagccgcaatcggtatcgcgctggagatgccaagctctccgctcaaaccggcgctgatcggcgcaaccgccgcaatcgtgcccattgatgttcccatcgatatagaaatgaaacaagcaatgataaacagccccggcagcaaaaactgctgcggaataatgctcaaagcaagattgacagttgaatgcaccgctcccatcgcctcagccgctgaagcaaaggcacctgccaatataaaaatcataaccataatgataatatcaggatgtcccgcaccggaagcgaaccattctattttttgattgagcgatttcttccggttaaataacagcgcaaaagctgacgcaatgatcgcggcaatcaagatcggcaatttataaaaatctccggtcaccagaccagagccgacaaaaagccctacgaataagactaaaggcaataacgcccaaggattcttatgattgttcatctgggtaaaccacctcttttcagcattaaagtcgctaatcacagtctaagcaacatttcacactttaaaagtctgcagtaaaaaagtcaagctgaaaaaaggataagtaatgattgataagatagaaaaagctgttttgtttcctctctttagaaaataaaaaaaaccaaggctcgtttcccttggtacatttcatgcggcccggcgcccgggacaccttctcttcattcagaaatacattcagctttcaatctgtttttaagtttcgcttcattttccaggatatcttcgtaatcctcaatcttcctgtttaatcgttttatggtttcatcaatttccctctgtttctccgtcagccttttcctttcatttataaggatgttttttcggggttcgatcgtatgatcggctccttcaataaataaagcggtatattcaatcagcgcctcaatcgacagcccggcacttctcatgcattttataaattgaatccaattcacatcatcttcgtcataatcgcggatgccgctttcatcgcgttttaccggaggaatcagtcctatactttcataatacctaagcgtcgcggctgataactcaacctgctttgcagcctgcgcaatcttcatattcttaccacccatccttcatacctttcataagcgtgccattatagaatatcatttcataaaaaaataaaccaaaccccttgacttaaagtccgctttaacatttaaagtaaaaccgaacagaggattcatcactttatcttggaaaggaagataaccatgtgcaataatcatccgactcgtgtattaagcgctccgcatgccaaagctaaatttgagcggacgacgattgagagaagagcattacggccgcacgatatcctgattgatattaagtacagcgggatttgtcactcagacatccacagcgcattcgatgaatggggcggcggaatctttccgatggttcccgggcacgaaattgccggagttgtggaagccgtgggtgaagaagtcaccacatttgccgccggcgaccgtgtgggtgtcggctgttttgtagactcctgcggggaatgtgaatactgcctgaacggagacgaacaatattgcacaaaaggcgttgttcagacctataataacctggactacgacggaaaccctacgtacggaggctacagccagaaaatagttgtcactgacagattcgttgtccgtattcccgatcagctggatttggatgctgccagtccgctattgtgcgcgggcattaccacctattctccgctgaaacactggaatgccggtcccggcaaaaaagtggcgattgtcggaatgggcgggctcggacatttagccgttcaattcgcgcacgctttaggcgcagaggtcaccgtcctcagccgctcaatgaacaaaaaagacgaagcgcttgaatttggagccgatcattactttgcgacaagcgatccggatacatttactgagctggccggacgatttgatcttattttaaatacagtatccgcgaaccttgacgtagatgcctacttatccctgcttcgcattgacggtacattggtaaatgtgggagcgcccgctaagccggactcatacagtgtgttctccttaatcacgggccgccgcagcattgcgggttcactcgtcggcggtattccgcagactcaggagatgcttgatttcgccgccgagcacggcattgctcctaaaattgaagtgataccggccgatcaagtcgacgaagcgtacgaacgggttctccaaagcgatgtccgctaccgtttcgttattgatattgcaactttataattctcataaaaaacataccaatatctattggtatgtttttttcagcccagattattttttatttcagcagccatccgggcaccgctttgatataaaccaattcaccgatcagctcaacaatcgtctgtgtgacgataacagcagcggctaatgaggcccaagcatccggcaaagccagcgctaacggaaggactgcgagagaattccttgtgcccgtgctgaagatcaatgctcttccttcacctgtatccagacggaacgcatatgcgataaaacgggagacaaacggcataatgagcaggaatagcagatagatcggaatcacacgtataatgatgtcagcatcattgatgactttgccgatttgtgtggcgacgaccgccaataaaaccagagccataaaaggaacaggcagccacgccgtccattccaacaccttttctcccgccggtttcttatcagcccataattgagtcatcaccgccgccagcagcggcaccgctattaacaataagaatgcttccagaaacggtcccgcatgaacagctcctatcacttctttcccgataaacagccacaggtataacggaagcaataccatctgaacggcgaacaaaaccggcgtggaagccagtattaatctctcatttcctttgccgagctgagtaaagacgatgacgtaatcaatacaaggtgtaagcaataccaaacaaacccctgataatataggaggagattgaggaaaaatggcggttaacacccatacaacgacaggtacagctaagaaattaccgatcagtaaggccgccataaacttgaggtttgacatggcttccctcagcttcaagaatgggatttgggcaaacatggcatacatgagaacagcgataaacagtgatatcgtccatccccagcgaagtcctgaatctttcccggcgatccccgctattcctccgatcacaagagtcacaccatatatccaaatttgctgtttttctaatgtctctctggttattttcattggctgacacctcttccccgcccattataccttcttttctgccggaattaaaaaacaccaagggtctgtgacacttggtgttttcaggacgtgttattgttgtcaaaaccgcttacgaaagcttatttgtgttctctgtcctgccaacgaataaggtgaccgcaacactcgctgaactgaccaaagtccccagaacggcagcaagaattgtcaaaaagccattgggaatcagaaatccaatcggaatgaggcccgcaaacgtgagaacgataaaacattgatagactccggatatgattctcacaaccaagctgctaaaaaaggacatgacgaatggcggaatgaacaaacataaaatgattccgagtgagatcaataaaatcataggctcgtcaaaagaaatgacacgattgccgggagactcttcagccgccgcgaatacagcaaatatagacatcatcagcgtaagaaaaacaagaaaaaaccttttcagcaacgttatgactccttttttataaaaacgggtatctttttttcaatcacaataaccattttatgttatcaaatgaaataatatgaagtcaaaccgagttctgcacctgatttatcggttcttatttttttgataatttccatataattgtccgcaagcagcatctatatcaatgccaaattgacttctgacggtcacgttaattcctgctgactttaattttttatagaagtttacaacttgtttctcatttacttcttcaaatctcataggtgaactaacagtcgggttatatctaatgatgtttacatggaacaagttccctctcttatatctgcttcttaaaagacgtactacttcattcgcatgatcaatagaatcattaactcccggcagcataatataagcaatataaacttttcttgaggtcacacgtatatgctcatctaatgtgtccattacctccaataacgggaagcgttcatttatcggcattaacttgcttcgctgttcattaaaaggagaatgtaatgaaaacgtcaggttgacctgcggataatcctgagtgatttttttaatgcccggaataatacctatggtcgaaatagataaccgacgagggcttaaagcaaacaactccggatttgtaagcacatgtaaagcatcaaaaacttgtacattcgctaatgcttctcccattcccataaaagaaatactatcaattgaatgtccttttaagtgaaagtacaaaatttggtcagtcatttcatctgatgttaagctgcgttttaaaccaatatctcctgttgcacaaaatgcacagccaaaatgacagccgcactgcgaggatatacaaaatgactcccagccagctttatatttcatattgaccgtttctattttttcgtctcctgaaatttcaaataagacttttgttacttgctcagaatgctgcacttttaaagcagcaatatttaaaattgactctccaaactcattcattaacaattttctcaaggatttaggaagaaccgttatttcattaaaatgatttattctccctttgaacacagcatttttgatttgattcattctaaaatcaggaaacttattttgtttcaggaactcttgaattcttatatacttgtttttttgttgcatgttttctcatccttccataaaactctggtttgtttgagtaaatagaagggagtgatcatctaacctttttttaaaatcaggcacaaaaaaacaccgacacaattatcggtgttacgcttaaataacatcatgcacaaataaacaaggacattatgtcattggattatcgtttatttgacatagagaaaaagcaccgataactgtttttgtatgatgatttggcttaaaaaaggacagactgctccctttatccgccaagatgtttccaatttttgcattttcaccatacaaaattccataaatcgttatcatcgctttcacctctttcttgtcaatattaacaataatcaccatatcataagggttcccttatgtaaagttaaacaaatgcttacgcccccgctaatgacagtattataaaacttgcttattaagcctaatccaagtacagaaagcgcgctgatcacatgtttcacttatccgcgacggaacatttcttatataatgggtgaccggcagctgcctgcttgaatcccaatcttcttatagtgattttttatattcatgacagtatgatgatttgtcacttcagcaatcagatcgtttattcgatccagattaatcggtttattttctgataagctgctgaagctttctctgatttcttcaggatagacatttccggccatgcttgacaggccgttacacccgttactcagcatcttcggaaattcaacgtctcctgccgcaaacaaaataaagtgatcagggaactctgtttgtttatgacgcagaacgtctcctccttctttcagcccccttatcccgggatgccggcttattaagtctttaagcgctttctcactcagattaaaaccggtccggccggggttattataaagcacagcctctttagaggtatgactgagaagttcgtcaacgtaataaacggcttgctgctgtgtcggtcttatataaggaggaaaaccaatcagtacagaatcaatattggttttctcgatgtgtttcatcagtttgacggcatcactggttcttacggctgaaacaccgaacatcagttcaacatcttcaaattttcgctgattaacatactcaatgatctgaagacgctcatctatgctgagtgaatgctgttcaccagtcgtgccgcatatgagtaacgaatggataccgctgtttttcaaatgttcgacaatagcatcaaatccttctaaatataaactttcatcttcatgaaaaggcgtagggatagcaacattaaaatttcgcatgagaatgtcctccaagtacatattcttgaatatctgcagagtatcatataacactgtctgacatttaaaaaggtacagtttcagataacgcaacatgtcagatgtaaagccgacacacaaaaaaagcaggcaaagagagcctgcttcatagcttcgtcttacagcggcccattccccggatggcttgacaaatatgagtaataaggcaaactgatataaaaattgtgctaatgaggtggggttaatgattttagatttaaaaggtgaaacgcacatggatcatcttgtgggaacgctgtattctgccgttaatgaaaatgacagccgcttaatatccattgtgtcagacatgtcacagcaggagattgattataaaggaccaaatcatcaaccattcaatggggaatatggcatatggcagaccataatagatatcatcaagctcatattcatcagcttcgcaaatggtatgaagagaaacagaaacttggcagttaaagccgcttattaggaggagcaacgataaattcattacaaatgtctattttcactgactgccaatcaattaaaatggtcagacaaaaatcgctattacatttgcaacgtatcttaatccggccggcgcagttgtaataaaaaaagaccgctttcccctcttcttcaacgtaactgacatcatcatcttcatttttcttaacataaggttcagcaaatcgttcctcggtatattccacacattgctttcaaatgcaggtgcaattctccttgaaacagcaaatggttgtttggtttattgaattctttcatattaaaaaatggagtcattttaatgatcatatcagtctccttccaaacgagattgcatttacccattatttgttattctgcaactgaatcattatcttttatatcaggaattcttacaaaaaagtaaggtaagtgtaaggtattcgcatttattcgatatgcagtgttcattagaataagaaatataaaaggagtgatgaagaatgaaaaacatgagcattttcattattatattaggctgcctatcggttttcatattaggaggctgcgctgatcaaggcgccgtgctggaaagcgattattacgtacaaattcacggaaaagcggaaaaaaacaaaaataatagcaactacgtttacaatttagaagggtataacgagaaaggtaagaaaaagatggtttctttctttgttgaaaagccttatcaagaaggtgacattgtacgcgttccgaggagctatgagggttataccggagaatctgaagctattaaggccgagaaactgcctgaaaagatcaaagaccgattcaacattgagaaataacagcgagttgagcagatatttaagtctgctctcaattttttacgacaggttcattcgaatgcaaaatgcaggatggctccttgggccacttctacataaaagattgtgcaaattaagcacaccctccccattttctttttttggctggttacaactatcggaagtggcattgacaattcttctatggtcccaagtaattaatgaactctatagtgggcggatacgtatacggcggggtttgcagttttttaacttcttgttatttgagctatttcgacttttacttgaaagaattaaattagagagtctgaacgaggagtgaagcacgcgctccatgtgaatccatttagttcaaactgaatatgcgcggactaaaatagttgcactgatggacgtattcaacacaaaaaagagcagtaaacacgtaagttactgctctcctcagtctatccgccgttcatttgttttacaatgtattcagcatcatttcctacaccttgaagcagcgctgaacctcgcctatgctgccaaggcaaaccaataaagtacaatccctccgcagctgaaacaccccggtgatgtataattcggccttccttatccaaaacaccttctattttcatccaccaaagcggattcttaaaaccagttgcccaaataacattgtttacttctaatgaagatgaatctttaaaaatgacttcattttgctttccggctatgactctttgttttaagatgatcttcttctgtcttattgcatgttttaattcatacccaaatatgaggtcgcctttcttttgaatgaacttgcctaatattgatgtatgacttgcatgtaaaactcctaatttatcaaaccaccaaaagatgcttctttttccaatccataaagggaaataaaccggttttttactgcaagccaaatatgtaactctttctttggataactcaacagctatctgagccccgctattcccgccgccgactaccagtacattcccaggcgccagttgttttgaatgtttatattgtgaagaatgtaattgacgaatatgaccggctacatcctttgatattgatggaatgttaggggtatgaaaaggacctgcggccaccaccagattcttcgtttgatattcttcccggtttgttttaattaagaaatagttgtttaatttttggacacttattacttctgtccgtaattggatcgggatttcaaatctttcaacatattttttcagataagcagcaatttcattttttgaagggagtccatgcttgtctccttcaagctgcattcccggcaaagagctgtacattcgagaagtaaataagaccaatgagtcataccggtttttccagctttcccccacttcatgacttttatctaaaatgataaacttttgtttcgacttccttagataatatcctactgagattcctgcctgaccggctccgattactatcgtgtcgtacatatgaatccccctccggttttatcttaattgtcagcagacaaagttagtccctatctcctcctttaatgatgatgatggtcacgcggattctcagtttgggcctgacaaagaatcgtattgtcgtgattatgcgctgccgtttccatttgaatggttacatgtgtaatgccttgatctccaagttcatgttcaattttgcgtaaaatactttcactttcagaaatggtcagctgatcgttaacaacagcgtggcaggaaagagcattcaatccgcttgtgatagaccatatgtgcaaatcatgaatgctttgaattccttctgtctcttcaattgtatgaatgatgtcagtgacatcgatattttccggagttccttccattaatacgtgaatggagtctttcgtcacatggtaaccgcttctcagcacaagaatagccacaatgacactggccactggatctgcccagctccacccgaagaagatgataaggatcgcagccagtatggcacctacagatccgagcatgtcacttatcacatgtaagtaagctcctctaatgttcaggttattctttgtatctccgccgttcagcataatccaagcgaccaatatattcacagctaacccgatgatacttatcgtcagcatgccggttgttgctatctccggcggatgagagaaacgtttgattgcttcataaatgatataaagggaaatcagtattaatgcaacaccgttgatcacagctgcaagaatttcaaatcgtttgtagccgaatgtcttatgatgacttgcctttttttcggccaatttaaaagcaatcagagcaaccattaatgagattgaatcactcagcatatggcctgcatctgacaaaagcgctaaactattggttaaaaatccgcctatcgcttctattatcatataacctgtaatcatgataaaagagatcaataaaaccttcttattggatccgccagcgtgattgtgattgtgacccataaaaatctcctccttatctaatacactgtatttattatttcttttctgctatgaagcattctaacacggacacaaaaataaccttatatgattatgtgctcatatatgaatatataggttctttactgaaatgtcaaaatattttcaatgaaaatgtttcttatcattagcttagcttgggaggttgcattgctatgaagccgcggattacagtaattactttaggcgcagataatttagaaaaatcgctgcacttctatcgggatggcttgggtctgcctacagaatacagaaggaacagccggtacagatttggacgacttgcaaacgggactgaaacttgccctctgggaccgcaaagacatcgcacatgaatcaaacgttacgataactgctcccgctcatgatactttttggggcggatacgccggtcacttccaagattccgacgggcacttgtgggaaattgtttggaatccgcactgggaatataagtgaataaccaacttttatagcaacaataaaaacacacctgaatgttctggtgtgttttttattttgtttcccacaacgatcaaactatttatacgatggcgggatgctttgcggaaaacggaatacattttcgggatcgtatttcgcctttattctttgaagccttgcaaagtttgagccgtaatatgcttttccgaagttctcgatattttgatccggaacattcacataagaacctgttacatatggtttcatcagctgacgcactctttcaactgatgcaagattcgaagcttcttgtgatttatttttccaactggccgtccattccgtataaaataacggacggcgccaatagaaggctgtttcactgcttggaactctgcttatcgcaccgccccaattgataaaaaagaaattggtttctgtcccagtcgctttttctaaaaattgtctcattactgcaataggttcttccggccaaagattgagcgcccacgccgaggagaatttaacactctgatcagacctgccgggaatcggttcatcaggatctaagaaatctatacaatccggatagtatagtgttttgattactgtttgtgccggcgttccggcatttaataaaggttttaataattgaatcagctccggttttgacccgaggaacaatccttccgcatggcacaaaccatttactttgctgtaaatctcaaggtagcatcctaatcgttcgtctgtaaacggtgcccatttttgccatgctttgaataccgtttctaactgttcccacggccaaataatattaaagacggttgcggttttaggggcacggtgaactttgaacgtatattgggtgttatatccgaaattgcctcctccgccgcctctggaagcccacagtaaatcttcattgcgggaatgatttgcttgaatgatcctgcctttggcatctaccattttcagtgcgagaaggttatcacttatcaggccgatcgatcgtgaaagcactccaaatccgcctcccatcgtgattcctccgattccgacggttggactgtctccgaacggggccataaaaccttcccgagctaaaccttttacaagcgggccgacgtgaatgccggtttgaacggttgccaccgcgtttttttcatctaagaaaacgttattcatgtcactcacatcaataacaatcccatcacttaccgtggaaagatttttatccagagcatggcggccgcttctgacacgcaaaggcacattcttctcacgagcccatttaatagcattacttacatcgtatgaattttgcgcaaaaacaaagacaagcggacagacatcaacataagggttccaattcttaaccgcctctgtatagccggggtcccctttgaagatgacacgtcccgttaactgtgctgatcccatctatttcactcccaataagcatttgattcccataccagtatatgtaggaattggacaaattcttagacagatgttctgcaaacttaaaaatagatacatatacgcgaagatgagaaaaaacaaaaaaaagacaagtgcggcaacctgccgaaactcttgtctctcctgccatgataggcacttacatttattggcgtgatatcccgaccaaactatggaagtccatagaacattatgtttgccctgccatgcgtggttctgctgagcaatctttctgtttgatcccccgacaagaatctttttctttatcgtttttgcacccctgtacggataaaatcaatacacattgaatcttatcttttacatgatgaaaagctcttattttttcttcttgtgcttacgtttgcaatcatgttttttctctttcttatgacgttttttacatttcgcttttgctttggctgctaattttgccgcttctacctttgcttcagctgctgcttttgctgcttctgccgctctggctcttgcttcttccgctcttgctatggcttcttccgctctggctctcgcttctgcttctcttgccgcttccgctcttgcatcgtcgtccgccatatcaaaatcatggccaaggtcacaggcctcgttgtatggctttttcttctggaagtactgttgatcgtcaccatcgttataatacattacgccactccttctctcattttttaatctctacatactatgtaaagaaagatctgcagcttggactggtattttgatgaaccggcacatttttagggcaattttcatttatcattgcaacagaatctggatgcctgcatgaaacttgaatgattttgacgattatcttaagcagcgtaaaaagggagactacgaaaaaaccaaggggttaaacccttggtttttttgtaaaaatgataaaaaggatgctgcacgctgcagcatccttctgtaccaactttttattgaacgattggaaagtattttttagcttttagtttgcttgctgtgtttgttttactggttctttgctaaaaagtccgacaatgttccacaagataatagcagcagctatgattacacgagccgtactgacttcttgattagtaaacaatttatagccatatattgatcccaatgctgctatgcaaaaaatattgaaccatttactccaacgcaattagaaaactccttataaaagattacatttccaaacaatatattataatattaacaaattttttcaatatttaaccttaaattattcttaagtggttttcctgatcattttctctaatcgtcattcgatctttcggagttttgatcgtttttttgttacaggctagacccagacatcattttcagctgtttgatcagttatttcctgcccggtattgacaacacctttaggttctgcaagcaaaatgttacactctgattctgcataaggtttatgttcaacatttttcggaatgacaaacatttcaccttcatttaattttacttttccatcacgaaattcaatgattaaattacccttaataacaataaagacttcatctgtttcgtcatgcttatgccaaacaaaatccccttgtactttaacaagtttaaaattgataatcattcatttcagcgattacttttggagaccattgatcttggaatgcagataatttctcttggaaattaatcggtttatattccattctttccccttcccgtgtaaaactcaatcatttaactagtcccaaattaaaggcctgtcaacctcagcagttctgaggtagtctaaaagctgaccggtatgtacagactcatggtaagcgattcttaataacatgtctcccagttcgcgaatatatccaacatcagacctgtcaatctttatatttgttaaatctgtttcgtttaacgatttgatgaatgtcaaaaacgcggcccgatacggttttgcaaattctaattcttcgcttactgtggtaaacgtttttgattcataaggattaatagtttcctctgaaaactcactcatatttttcattaaaatttgatgataaagaaattccgcttctaatacatgtcttatcatttccttgcacgacatggcttcggagtccgggcgccagtccattttttcctcaggtacagctgtccataacttgatgcttcgccgtcttacctcttcaaaatgtaaaacaataaggtcaattgtattcaagtattttcccccttttatttttaaataataattctccttcttcccggaaaaaacctcttcaaataaaaaacatatcctttcccgactcgccggattgataatcaaactatttttaagataaggagatattcattcatccatacaatagactctggctgaacatatactgaatgatagttttcatcagaaaggagaaatcagctttggcaaaatatcggatcatgacctttgacgggggcggtaccttaggtgctttaagtttacaactattgaacagactggctgaagaaaatccggcattaataagccgaacccatgtatttgcgggaaattcaatcggttcatttactgccctggcattagcaagcggaagatctccgaaggaaacacttcagtattttgaggatgaaatcctgcccgcattcagcacttcccggccgggcggacctgtttttaatcagcaattaccctattccggttttattaaagcggtacgaaactttttcccgccaggccttcgtcttaaagatgtaagaaaacgaattgttgtcccttcattcaaattatactccccggcactggatcgttggacgcccgtattatttcacaactttcccggctctccctatttaaatgagaaagtgagtgatgtcatactgcggagcagcggtgctcccgcgacacagcgcgcctatcaaaactacgtggacggatatgtagtggcaacgaaccccagtacggccagtatcgcgtttgcggttggtaaagccaacgtgccattggatcaaattgcggcgctatccatcggtacaggtgaagccccgactcggttaagaagagatacgaggggatggggaatggtaagtgcggataacatacgtcccgaaaatctgaagaaccttcctccaaattggggagtccttttggacaggtcgcctaatgaacctttactgccatttcttcagatgatctccggcggaaatggctactatgaatccatggtcagcgcgaatctgctgggagatcgctttttccggttagatccgcggattcctaacttctccaaaacagacccttccgtggttcccgctgtcattgaaattgcaaacaaaaccaacttacagcctgcgaatacatttatagagaaaaactggaacgacagcgctaaataagcaagaagtttacatcatcatacaatgaacaaaaaataccaagggactcaaacccttggtatttttaatgcgttcaatcgggccatttattgaatagaactgccccagaagtcgcttcccattacgtaaagaaagcgacttttagatttgattttcaagttccttttacaaattttgaaaaggccattgactattcagttgtactgtattaagtttaactatatagtcgaactgaatagaggatgaggatatgaaacataaattattaccgctgtctgaaaccatgcattatattttattagctctgcgtgagccgcttcatggctatgccgccatgcagaagatagaaaagatgagtaacggaactgttattttagcagccggcacattatacggcgcgattgaaaatttgaataagcatggctggattgagcctgttggagaatcaggccggagaaaggtttatatgataactgcggaaggaagcgccattttgaagatggaacaaaacaggttactgcatattttatccctgcacgaaggaagtgaatcgaatgaagaaatttaagatgttttttgatattgaaaaagaggagcaatggctgaacgagcaactacaaaaaggctatcgctgtacaaatatcagcggattaggaatatacactttcgaaaaaaccgacaaaaaatatgtgatgagactggattatcaagattgtttatcaaagaaaaaatttaaagagtacaaagaaatctatgaagacttcggctgggtttatataaacagcccatggcttagcggaactcggtattggcaaaaagaaaatgatgatcaaaatgaaatcttttcggatcgccaatcaaagagtaattattataaaagactaatggggttttcatcttgttttggtttactgtgcttgttttattcttatttgatttacaaggattcgggtttatatttaactgaaggtctgtggagtatggaaagcgcaatgttttggaaagcatttttatttgaaactccatttgccctgttgaggtcgcttcccgcccttatggctgttctatttggctgcagtttctataaaacgtatcgaaagtattcaatgttaaaagaacaataacacggggaagttacattcaaagaagtaattgaggatcatgcatctgccgaagccgggcgctttaaaggaaaaaaagcgccctgaatttgctgataaatcagatgacttattttgttaatgatacatacttatttacaatggcttgagcgagacaggctgatgaatcaacaatagtaagtccgcttcttttttggtccgtgaccatatttaaatccgtacatgcaatgataaccgtatcagccttttctgctaagtcatggtgtaattcatcatataatgtaccagcctcatcgatttgaccttgtttaattttttctattatttgatcgacatagatttgccaactatcttgatgtaaaaaatcataaccttctctgtttaacgcttcttgaaatattccggattgaaccgtaggaacggtggctaaaagagctgctttttttgagcctttaggtattttttttatggtttcatcaatcatgttcagtaaagggactgaaatcgatttttttatttgattaaaatagagatgtgcggtattacatgggatggcaataaaatcaacacccgttttttcaagctttacagcacccttaataattgcattttccatgtccgtatgattgagaggtttattcatgtagaaaggtgtcggacaggaataaatcatcatatgtggaaaatccgtgtcatgtattgctccatatattttttggcactcgtctacgactttatctacaaatggcccagtagattttggccccattcctgccagtattccaatcataattgtcctcctctgtaaaaatgtgtacgaatacgatcacgatgagttattcttgtgtttctcatctgaatctgctctcatttcttttctggctttcttctcctattttatcatttcattaattgaaaaagggctttaaaaaagatagctggcaaaccagacgacttgctttaagtaacggcgcagccgcaaacaaaaaataccaaaaacctcagaacccttggtatcattgtgatgcggctgagaggacttgaacctcaatgggttattcacccgctgggccatcaataaagtgaaactgtgttttctattacaaaacctttatatattagtgtgtgtttatattgatcatgttattttacaaagattaattcatattgtggagtaaaaatggagtcgtttttttcatcaccagaaagttacatgacatgtcttgggtgccatgtttgttaaaatcaccatcttcgttttaaaacgtacaggtttatagtgttccaaaacgctgtcctaaatgcaaaaaaatactggacgcaactaagtcaaatgtttttcacggtactatagtcaagacttgcccaagtcaccattatcaaaaagaattaataagaaaccaacgggtgatgaatcttttaatctttcattttacccgctgactcatatcaaaggagctttaaccaaattttaatagctgtcgcacttattaatagcgctaaaatccattgcaggaattttgtatttgctttttgcccaacagatgcgccaataggagaagcaatcaaactggcaatcataagaaccagagccggtgtaaaaagaacctggcccgtgattacttttccaactgttgcgccaatagatgaaagaaatgtaatcgcaagagatgaagcgactgtgattctaacagggatatttaaaatcgataacataatgggaaccaggataaaggcgccgccagctcctaaaatacctgatacgccgccaatgagaaacgctagggacgaagccaaccatttattagatatcacttcttcgtcttcgctatgttcttgtccttttttaggtataaacattaaaataactgctagtatagccagaattccgtatataaagttaattcctttttcagatatataatgagaaaagtaactccccaatacactccctaaaaggatgctgcttcccatgtacataattaatgctttatttaaaaaaccacttttacgataagcccaaacacccccaagtgtcgcaaagaaaacttgaatagcccctatccctgaaacttcatgggcagttaatgacatcactcccactaaagaaggaatgtataatagcattggataattaataactgatccgccaatacccatcattccggaaataaaggcaccaataaaccctataatgaaaagagttgtgataaaagcaatatccattttggttcctcctttcaaagaaaaagggcatctttgtattcgataccctttcacattcattagctttttttaatccagaattttaatacatcgccttcatcagtttgctctaaaagatcatgcccgcctgatttagaccaagctgcaagatcatttttagctcccttatctgttgcatgcacttctaatatttgacctgattccagttcattcatcgctttctttgttctgacgattggcattgggcatgccagaccttttgcgtctaatactttatctgatttcatgttcatctctcctctttttaatagaaacttgagttaccgtattgcacagcggtttggaccaatctccatttcacgctgtttttcttcatctgggctgattttccccatgtttgtttctcgaatctcttggtatgcatttggctgcggaggcaaatgatctgttactaagtgtctgaattctgtttcatccgcaatgttcaaaccatggttctcgctaaataatgtacttagttttttaccaacacttccatccttatttagctcgtcaatgatcataaagtgtgccggtaatacaattaaatcctgtgacaacgctttgtaacggctataaagcgttgttcttaaatctcctgcccaatcttctgccataccggctaagtctggtctgccaattgaatcaataaacaagatatcacctgaaagaagatactgatcatcgacaatgaaagaagtggaaccaatcgtgtgccccggagaataaatcggttgaattttaatctttgtatttccgatggtcatgtcgtttccttcttccaacggctgataatcgaataccgcttcttcagcatctttaggcggtaaccagtaggctgcttttgttttttcagcaatgactctgccgcctgaaatatggtccgcgtgaagatgtgtatcaaatacgtgagtaatcgtcgcactcttctccttcgcaaaatccataaagaaatctaccatacgcgtcgcatcaataatcgccgcttcaccattggaaatgaccatgtatgataggcagcctttaccgattcgaacaaactgatacatctcaccgccatcttttaaatccccgacttttaccggctctaaatgttcgctccatgctttcattccgcccttaagataggatacagaatgacctgcttcagaaagcatttcggataccatgacagatgaaccttcttttgcacaaacgaccagcacatctttatcagaaggaattttctccaagatatcttctacgccatctaaaagatcgaaatacggtacatttaaatggttaaaatcatgtccttcaatcttccaatcgctaaagtcattttcattacgtacatccaaaataaataaaggttctttgtgaaagattttttgtgtgacttcttttgcggtaagtgcttgcacggtcatgtttacatacctcctttttctgttttacctgtccagtcccgcataccgggaataacattaataacctttttaaaaccttgttttttcatggtgtgagctgccatttcacttcttcttcctgaatggcaaataatataaatttcatcatttttgtttaattcgttaaagcgcttttccacttcgccaagagggatatgcaccgctccggggatatgagcttcttcatactcctctatctctcgtacatctaaaatgtgaagagactcatcacgatccactttctgtgtgaaagcttctaatgaaatctcaggaattgaagatgcattttctgatgaatgctctcctccttttcgaagaaagtgacgaaggacttctccctctgtttcagtacctagatattcatggcctgagctttttgcccatgcttgcagatctgccgccgatcctttatctgttgcttgaatttctaataggtcaccagcttttaattcttttattttcttctttgtttttacgataggcattgggcatgacaaacctttagcgtctaatacaatatttgctttcacggtttttttcctccttttcttatataggggcggggtatataaatatgcaaaaagttattccctggatgttaataccatgtattcataccgccttttatatttgtgatgtttttaaacccttgtttcttcaatattttacttgcctttacacttctcattccgctttgacagatcacaaagacgtctttgtctttcgaaagttgatgagtttgacgaggcaagatagacaaaggaatatttttgaatcctttaatatgccttgtacggaactcataagaagttcgcacatctataaactgtttgtctttgttttccgcctccgattttaaatcagcagttgttatttgtttaacaccatgcaatgggaaaaaacgtcgaaatacgatccaaagtattgaacattactccgctattcatagtgttatatcccccttcacttattcaattgcaatggatcacattagataaataagttgacattgccttcctcagcgtctgccaaataagcagctacaccagcatagtcgatatcatctaatagttctttttcctgtaaaccaagaagatccattgtcatcgtacaagctacgagctttacaccttgttcttgagccatctcaatcaactgaggcaacgtaagtgcattatgctttttcatcacatttttaatcattttagggcccatacctgcaaagttcattttagataaacccatcttatcggcaccgcgaggcatcatctttccaaacattttttcaagaaatccttttttcactggaatcagctcttctttacgtaaagcgtttaatccccaaaaagtatggaagatcgtcacttcatgatcgtaggcagcagcaccatttgcaataatataggctgccattgctttatcatattccccgctaaataaaacaattgttgtgcgttttgtttgttttgtcatgtttattctcctgaccaatcactattacccctggggtatattgaaattaaaaattttttcgaaagatctcctattattcaattcaacatattaaataccggtaggggtatattataatgaatataaaaattcgtcaaccttaaagatgataggttgatgaatttttttatcggctctttaccaataagtcgaccgcttcttttactaagtgttgtgtgtcttctcccttttctaaactttcacgaacacaatgttcaaggtttgtgctcacaatcaaacccattgctcgatcgatcgcattacgtgaagcagctaattgggtcacaacctctctgcaatcttttccttgttccatcatggtcaatacaccttttatctgtccttctatccggcgtaagcgatttttaatcttttgatcatattccatgcgttgaactccttctttgaaatttatatatttgcatgttatccactatcatttcatactgcgctttatcacactacattattaactagataatgtttgtgaatcaatattatacccttacaggtatactgtcaattttcaagacggcatgagaatgattttaaagagttaatattagtatcccctgtttaatcacaagaaggcgctgaagttgtacgtgatttaatgcgtatgaagaaagagaaagcacttaattcaagcgaaaaaaatgttggataatgcatatgaatttttgattagtgaactggaagtcattaaaggaatcactgaaaaacaaataaaaagtttctgttaaggttaatgacagataagtttttcagagtattacgatcagacgttcaacttcttcaacttactttttaaacattaaccgcttttattactcctcaatctaatctgttatatttttttcttcaacgaacacttgaattctcgatgaaatagtcacttgatttttgtaatcctgattcaccctggcacggacaaggagccgtaacgatggaagagaggcagggctttcattgttttaggtctaagtgattatttccggaagaaaaaacaaccactctcccctttatctttcagaatttcttacatctcttgcgacagtgaatagcagttgtttatcttatttcataaaaaagatatgcgaattgtaacaaagaataacataccgttaccttgagaacataaaaacaaatcatttatatattccacatatcgtcaatccggtatgttatactgtaaacaatcctttgaggttttaaacctttttcttaccttgtagcatctgtccctactcgaacggtgagtagggttttttattcagtatgatacagagaacataaaaaaacaggccctatataaagagcctgtttgtataaacgattgaagattaagcagttttttgaacgttagcagcttgagctccacgagcaccttgctcaacgtcaaacgttactttttgaccttcgtctaaagatttgaatccgtcactttggattgcagaaaagtgtacgaatacatcgtctccattttcacgttcgataaatccaaaacctttttctgcattaaaccatttaactgtaccttgttccatttttgttgcctcctagtgtattacacattgtattactatccttgcccaaagtatcatcaagacgaaaagtcgatattcatactatcctttacacgaacaaaaataattctcctttatcatagcacgaaacggaaataactgcaaattaatatcatgtttcattcagggttttatttgttaaacgtgcggcaggtttttttgcgagaaccttcatttggaaattagaagttttgacggaccccttaccgtactaaataataaatatcatgttgagaggtgtatttttaaaaagcccactcacgaaaacgagtgggtttacaaaagctctaactaacccgcaaaggttttagtcagagctatttattttttgatccaactcactaagcgcctactctgtcatcagctcgataatattcattggaacgtgataaatcccctttttcataaaaataatcagctactctgattgcaaagttttcaatgtctccgtacattcttaggaggaagataccattagcgatgacgctaatggcgccctttgtttctactcagtaacttattcagcttctcccacaactgtaaagcgttcatttatatgttttggattttctatttcatccaatactgcaattgcatagtctgcatagctgatataactttcgcctttcgagttcacaagaagatgatcttttcctgactgataaaacccagttcttttcccgtctgggtcaaataccgctgaaggactgataaatgtccagtttatatcagaagtttcctttagctcttgcaagttacgaccttgccctttagctgttggaataaaaatctccgggaaatcaggtgtatccattacactgacagttttattttcgtctacataaagactccctgctccgcctacaattactgctcttgtacctattccttttaatgccctaattaatgcccggccagcatctacatgtgcctgttcttctcctaatggagctccgaaggcattaactattacatctaacttttttagatcatccgatgtaagatcaattatatttttttcaatgattgaaaccttttcctctttaagttttgcagcatctcttacaattgcagttacctcatggcccctgcttaccgcttctttcaagataagacttccagcttttccggttgcaccaatgattccaattttcaatttaaagtcctcctaatcattcaaaattttaaatgtaaccaaattgattacatgtaataattttagttacaccttatttgtttgtcaatacttttatcaccttgttaattgagcatattagagtgaaataaacttgtaatacattcagttacaagtgtactataaagagtgtaaagtaattaggatggtgaagaaatcatgtctattagcagccgttttgctgtaggaattcatatattggctcttattgaaataaatgaagacggaattagcacttctgaatttttagctggaagtgtaaatacaaatcccgccttaataagaaaaattatggggatgctgaaaaaagcaggtttagtaaatgtacggccaggtattgcaggagctgaattagcgaaggatttaactgaaatcaccttacttgatgtttatagagcagttaatgttgttcaagataaagaattgtttagtatacatgaaaatcccaatcctcaatgtcctgtaggccggaacatacaaagtacaattggtccaatatttgaaatcgcccaatctgccttggaaaaagctcttggacatataacaattgaggatgtggtaaaggatattatcgaaaaagaaaaaacggccgataattgttaaatgattcacagaaaatcttttatcagactggggataagaaaaatcaataaaacaaaaagggactggatcatattgaatccagccccgaattgatattgattttagatttagattacggtaagggatataaaaatgctcatgataaagagaaaaaattaacgacaatgcacacgatgccagattctttaatagggcgtgagtattactatccaacaactcaaggttcagaagctaagttcaaacaaagacttgaggaaatctcggattggtataaaagaaaccgcaaatcttagtttgaacgaatatgttctgtatataaaaataatgaggtatggagtgaattgataatgaattatgatgaaataaaagattactgcctaacctttccaaactcttatgaagaccacccttttggagatggttggactgcaattcggcacaaagggaataagaaaatatttgcacttatcttcactcgcgacgaacacttatgtgtcaaccttaaatgcgaacctgaaagggctgattttctgcgtggtctttttgaagaaatcaagcccggataccatatgaacaaggagcattggaatacgcttaccttagatgagggactcccagagcatcaaatccatgacatggtaaagtacagctttgaactgacaaaaccaaaaagtaaaaaggaaacataacatcgaaggatagaacgctcattatagatattcatccggtgcaatgatacagaggaatatgcaaaaaacctcaaggtagcaatttttaaattcgtatttacgagatgattttttcgttattgtgagtcctttgtttctcgacataggttgaacaaataaaaaaagagcagactcaaaatccactcaattaattaagatgattgctcatttcatccagacacctataaaaaatgaaaggtgacgatgatatgccgcaaaggtcatttagcgtttaattaatactgataactcaccttcaaacactttttcctctttctgattataggtagataacaatacagtaagtatccccgtctggcttttatttggttttttatcaataaccttaacaatagtgttcagtttatcattagggtaaacgggtgctaggaattttatattattcattcctgtcccagcaataatatcgtcttcatgacacccttcttcaatccaaagcttaaaagtaatagataacgtttgtattccagaagcaataattccattaaacctgcccatttttgctttttcttcatttaaatgcatgtactgtggatcatacacttctgcaaaattcattatattctcttttgttaattcaaaagatttagtttgaaaaacctgcccgatggtaaattcatccaacttcataaataaatctccttgaatctaaactttattattaaatctacgtagcattttaacatactggctctcacacaacaacttaacggtaaaacaattgttcccctatcaggaatgaacaagcacattgtttttgtttccttgcctttaacctctttataatcaggtgttttcttataaagaccaaggcggtcgccatcaccatcacccggcatatgtgccatttcctcataagaatctccaagcttctcataataagaataagcagtcagcctacgagaactttcttctggctgataaaacgctgaatatacttgccgtcatcatatacagaaattatggcgttatctcttttgtactcatctgaatctgctcgcatttcttttctgactttcttctcctgcttcatcacttcattaattgcattatcatatttactaccgccgcacgcagtcagcagaaggatgaaggtgactgacaaatcatacgacctactataagtaagtggacagtaacagatgaatttttataaacaaaaaataccaagggtgtcaaaacccttggtatcatagggatcggccgagaggacttgaacctccgcaggttattcacccgcttggcccgccatctatattcataaaactattgctcagttgtcagcatgtgaagtaaattacgaatttccttgttataacttttaatttcttcttcattacaaccggttttatcaaatactgcattaggtatcattgtgactttttctttaaactcattcccttcagttgttaacgtaataattacacttcgttcatcctcttttgaacgctctcttataataagacctcgctcctcaagtcgttttaaaactggagttaatgttccggagtccagatataattcttcgcctaaacctttaacagatattttttccttctcccataaaacaagaagaaccaagtactgtggatacgtaattcctaattcttttaagagaggatggtataactttatcatttcacgggaagctgcataaatcgcaaaacatagatgattacttaacagtaatttatcattcttcatgttaaattcctcacaatatttatattcattactacacataatagcataagaattacattaagggaaattgaatgactgacaatttaattaaccataacttatatacatggaaactttatttataaccaaaatgtgtttgaggtgcattcttattatgaccgatatagatacttccactatattgtttagaccgactcatagatttattgagccaccttctcaatatggttattatgtacactaactttaaactgcggaaaactgttctttattttagtctaatcattcatttagagaattttaattgcgaatttaaattgagagcaatttaatttcaaaaaatttaattgacaacgctgattagattgattaaaattcaattgtgttaaatttaatttataggagtgtttgatgatgacagtatattttacagcagaagctacaacaaaaggcggaagagaaggtcatgtaacatctaatgatcttattattgatttggatttagctatgccaaaaccaaatcaagtatccgcggctacaaatccagaacaattatttgcggcaggctattcagcttgttatgacagtgctcttcatttagcagcccagagacaacgattaaaaatcgaatcagctgttaccggtaaagtaagtttattaaaagatgaaagtgataatggttataaaatcggagttgttctggaggtggaaattcaaggggtatctcaagagcaagcggaagaattaacacatgcagctcatcaagtatgtccatattctaaagctactcgcggaaatattgatgtacaaatcattacaacagcaatgtaagacgaaagatgccaagatcaataggtaatagaataaaaaaatttgattaaaacatataggtgaccagccttcaaataaggagtgagattgatgttaaagaaagtacaattagaaaaagcagctcaagaatttgcagaagcaaccgcgaacccaccctatctattcgaccttggacctgagaaaggacgagaagctgtagatgaggttcaatctgccccaattgataaactgccagttgatattgaagatgttatgatttcaggaggaccgagcggacaggtatcagtaagaataatgcgcccgcagaatgcgcctgcgcaccttcctgtcatcgtgtacattcatggggccggctgggtatttggtaatgagcatacacatgatcggctcatccgtgagctagcagtcggagcacaagctgctattgtctttccaaattacaccttatctccagaagcaaaatatccgacagccattgaagaaatctatgcagtagtgaagtgggcatctgaaaatggccgtgagaacggcatgattcccgagagtctaacaattgcaggtgatagtgttggaggcaatatggctgctgctgtcacgctaatggccaaagcacgaggtgacttgaatatccggcaacaattacttttctatccggtaacagacgcttctttcgatacggaatcctatcaccagtttgctgcaggatactttttacgcaaggacgcgatgatgtggttttgggatcagtacacaaccaattcgaacgagcgtgctgaaattacagcatcacctctgcgtgcaactgctgagcagcttcaagggcttccatctgcattgattatcacagctgaagctgatgtacttcgtgacgagggagaagcatatgccaataaacttcgtgaagctggtgtttcggtcactgccgtacgtttccaagctatcattcacgatttcgtgatgctcaacgccttagctaaaactgaagctgcgcgcggagcaattgatctcgccgcaacctggctgcgtaaagggttttaatccatttattgtttcgtcacatagagactgctgcaaataaataaaaaacaaacagatccactcaaataattgagtggatcgtatattggaataatggaacttttgatgagctttttaatcgggctggttattattttgttgttgagatgtccctaattgaaaagctaactccacaacaaactccgttttttcaccagttcaccctcttcatatccaaaaaacctttgttgattagttagcgtacaagttctcgttttctgctttggaccccatacagaaaataaaaagccagctctccttcgggagaagaactggcataacaaagcttcttgcttcttattttgctgtattgcccggaccttttaatttctcttcgttcttgcgtcaatgttttattattaggacacaaccaataaaataatgacgatcgagaatagcaacgctgcatttgcaaagcagtaagccctccagaatataaaagagctgcagtcattgctgctcggataatcccagcttattctgagtctgtatttcgagtagtcggtcaattaaatggatgtttttttcattccttttctgtttgttccattttccaccacagtgaatcttttggattttcaacagcttcttgaaactcagctttagaagcaactgttgggtaagaaccttttaaagatttacctgaagtatctttaaataaggttaacacaactattaagccaattaaactgactgccaataaatagaaacccggcgccaaattgtttcttgtcacatgggttaaccaagaagcaactaaaggtgttgttccgccaaaaatagaaactgataagttgaatgtccaggataatgtacgatatctaatgtcagtatggaacaacgtaggtaaagatcctggcatagtaccttcgtatacagataatacaatacctaacattaaaagtcctataaataagaatgttatattccccatattaagaaattgaaaagagataattgaaaatacaattcctaatactaatccaattgttataacttttttatttcctaatttatctcccagtttaccaaaagttaaagcgaacggtaccataataatcaatacaattgctgtaaccggtgtacttatattatcacttataccaaggttctcatctaaataagaaggcatataccctaataataggtaattggttatattgaaaaatgccacaaatacgatacataaaaagatatcttttttatatgttttaatgacttctaataaacctggttgttgttcttggttttcagagatgtcactttcaaagattggtgattcatctagatgacttctcaaatataaaccaaataatcctattggaatacttaagaagaaaggaattctccatccccaactattcatttgaacatcagataaagtccagaaaagtactgtaactaaaacagaagctactatataaccagataatgtgccgatttctaaaccgctgcctaaccttatacgtttattatctggagaagattctgcgatatataccattgccccagcgtactctccacccacagaaaagccttgcagaatacgggcaaagagtaataatataggggcccataccccaatctgatcataggtaggaagcacaccaattattaaagtagataaagccatcattaaaatagtaattgttaatactattttccgaccaaatttatcacccattttaccaaaaataattccgcctaccggtctaagtaagaaggcaattgcaaatgtagcaaaagtaaatattaactttaattcatcgttttgaactggactgaaaaagtttttactaataataactgccaaataagaatataaagcaaaatcaaaccattccatcgcgtttcctatccctgtagcaaacacgcttttcttcgctttttgaatgtctacaacgttaatttttttcttgttaaacttcatttaataatatcgactccttaattatcaaatccacattatacaagcgcgtaaacggtccgagcatgcagtcccagaatgtatagcgtaatgcttctctaaaagtccgggggtttctgtttcacctgatggagagctaacggcatagtggctgattggttcaactgtaccttaaaagactagactaatatccatatcagcgccaaataacattgtaaaccaggaaagaaggatgaaattaagtgttttcgctggtttccttaacttatttttgccgattgggctaaaaataatacaagaagcaacaaaaagagaaacagccaacagataataccagcctaagcggttagtgagatatccttgggttgtggttggtattttctgcagacgatttggagaaatgattccccttcatacagctctattgtgaatatgatcacaatcgaaaaaaaacttttatttcttcaaagtagcctaaacctttattttagatcttccattacgtcttccaatatgtttattataagattgaggtcgttcctaagaattatttactgattctatctttattaccccacaatcaggtgaaacaaaacactataaacgtagcatacctttttaaaacctgacaagcccaacggggtgatagaaaccaggctaaagccaagctagtcaatggatagaagaaatttttttgtttttcccaaggaataaccgtctgcgtttaatctagcccaattagaaagaaaaagagcaggagtaatcctgctctttcattcaaaactttaatttgtatgacgaatttcgtataccttttcaactttctttaccttagactacaacagaaataagtagcacagggtatgaaataatggttttatttaaacagtcaatcaccgacaattgaatttattgcatgacacctgacaaaatttttttatccagctggaaataaagtaacattttttaaggtaatggatttatttttgttcaatgattaaatgatccccaatgacaataaagactaataattactaaaatttcaggaaaccccaatattgcttatcttaattattgtttaactaattggtaattgcaacagtaaacttatacttatggaaagttataccaaccgaaaattttccgactcaagtctgtttaaccagttgtgaaccaatgaattaaatacatcggtttgttcgatttgcaggttgtgaccagccatatcaagtactgcaaaagttgcccttgggtaatcttcgagtagccgccacgcatcatggtatccgactacattgtcctgacgccctgtgataattagcgtgggataatcaagtttagatgaaatatcgaaggtaaacccatatccattttgacgaatgttgtttacgaattcataatttgtttgtttagatggaagtaaaatttcatcccgaaacctctcccattcagttttaccttgcacaatccccatagagcaaaattcattcgcctcctctgaagacaaatgtgatatcaagtcgctgtctctttttagaacagtcttctgcggtactaccctttcatcgaattcgggtatagttaatggtgccatcagcagtaatccacgaactgtttccttacgtgaacgaacgatacctctggcaatgtaccctccatatgaattaccgcaaacaataaactgttgatcaggaataatctcgtccaaaagacgcaatatcgcttctaaaacatcatcagagttctgaatagatggttgtggcttagaatgtcccatacctggtaagtctatgtatattctcttccaaccgcttcgtttctcgaataacggttccattgcatttaacatcacctgatggtcaagtgtccaaccatgcaacataacgatcggatatccatctccaattactttatggtaaatcgacatgtagttgttccccttccctgtaatcctaatgtttcgacatgaacatttaatcctttcatacatttatcacaattttaacaaacttttaactgaacttggtaagttgaacaagggttatacattgaatttcgacaatcgcaaactgtcatatgtgtccgtcatatcaaaagaatctgtttaatgtgttgtttagtgctttcgttactgcgactatcgacaaataagaaccaagcaaagtattgtccagatactttgagtattttgatcactttgaactttaggtaagtgggcagtttgtgggcagtagatcatttaaaaataagcgcaaaaaaataccaaggatctctctattacccttggtatcattgggatgcggcgagaggacttgaaccttcacgggttattcacccgctgggccctcaacctagtaaaaacctatcatgagtttcaaaagcttttattcaaagcatctgtttattttatttatacttattttcatcatttttcatgaattccgagcacaaactgggcacctattagagaccaaggaaatctacatttcaacaagaaatatctactcatcgccctgctgtaattagtttatttcagcttccctcgcgaataccggatcaatgctcagctttaagatagtcaaccaatttctccgcactgttcttaacatcttcttttgaaaggtgaagtgtaccatattgtgcaaaggcaggaagaaaacgcattcctatatagttagcagtgatttgaaacggtctgataagctcgctgatcgtgatattatattctccgcctgcttgataatcagattcctgtgcgcctaaggagatagctaagagtagttctttgccatgcaatttagtacctccagttccataagcccaaccatgtgttaacacatcatcttcccattgtttgagtaacgcgggactgctgtaccaatacattgggaactgaaaaacgatgcgctcatgatctaacaggagctgctgctctttttctacatcaatgataaaattaggatattcaccgtacaggtcatgaaccgtaatgtcattctcttgctttaaacgattcatccaggttttgttgacaacagacgtttccaaattagggtgtataacgataactaatgttttcatttgactgattatcctttcttcgccgattagttattattgcttttacgataatgaattgaattaattttaaaatatcaactttatttacacctattttatcctttttcgtgaattcagggcaaataattgggcaccgattacatttatagccaaaaaaagacttaaccttttaaaaaagattaagccttttcagtacctttatgcccctaccctattatctcgtgtctaaattctaatagctgataatataacaaggcctctttgttttcctccatgcttagcaatactttctctgccttttgcaaattggagtttgaggcattagtaactacctataatgatgaaaatatttgtgcgacgtcaactgtagatgacttactccaggtaagtgggcagtttgtggatagtagatcatttaaaaataagcacaaaaaataccaaaggcggttaaacccttggtattattgggatgcggccgagaggacttgaacctccacgggttattcacccactaggccctcaacctagcgcgtctgccattccgccacgaccgcgtgctatgaagctgtctttccactaagcatataagctagtgatgatgatcagcactttgaaaagaaagtgcgggtgaagggactcgaacccccacgtcgtaagacactagatcctaagtctagcgcgtctgccaattccgccacacccgcgtgacaagtggtgagccatgaaggactcgaaccttcgaccctctgattaaaagtcagatgctctaccaactgagctaatggctcgctctaaaagtgattcaaaatttttaaataaaatggctgggctagctggattcgaaccaacgcatgacggagtcaaagtccgttgccttaccgcttggctatagcccaacgaaggtaaatggtgacccgtacgggattcgaacccgtgttaccgccgtgaaagggcggtgtcttaaccgcttgaccaacgggccgtctggttgagaacttatctggcggagaaggagggatttgaaccctcgcgccgcttacgcgacctacacccttagcaggggcgcctcttcagccacttgagtacttctccataatggctccacaggcaggattcgaacctgcgaccgatcggttaacagccgatagctctaccactgagctactgtggaatgatcagactttctttattataaatgatgcgacatattgtgtcaataagcaacatttattttttttgagaaagcatcgttgtctctcaacgacttttataatttaacacagatcattgaaatgagtcaagcctttttaaaaaattcttttgatttttcctctgcactttccgcaggcatatctttccgggttcattgcccgcttctttatatactgttggccgcaggcctcgcatctatacatatatgttttcttttgtgtctttttggtttgcagcggcgtgcagaatcttggcgctccgactttctgaagcaggtctctgaaatccttgtctctgtgcttgtacccttttccctcaagatgaagatgataatggcacagctcgtgcttgatgatgcctaccagctcgctccgtccgtgttcgagcagatattttcggtttaattcgatgttatgggaagacagcatgtaccggccgcctgtcgttttcagccggtcattgaaaaaggcccggtgacggaacggctttccgaaatcctgtgcagagatgtcttccgtcagcttttgaagttgttcgttatccatatgtgcaccccgctttaaaaacattgaacgggacaattcaccgttcgcatacaatgtgttaaaaccgacctctaactaaaagctgaggaggaatgagccatgccgaattggctgatgaaacaaatgcaaaaagcgtttttagaaaaggacaattaccaaatcaaactgctgaaccagtgctggtatttctacagaaaaaaacactgctcgtaagcagtgcttttattttaccatagacagcgacactctgcctttttgcacgtccaccccttcgacccatacggtgacgatgtctccgaccgatacgacgtcgagaggatgtttgacgaattgattgctcagttttgagatgtgcacaagcccgtcctgcttgacgccgatatcgacgaaagcgccgaagtccacaacgttccggacggtgccctgcaattccattccttcctttaaatcctcaagctgcagaacgtcttttttcagcaaaggcttcggcacttcgtcacggggatctcgctccggccttgtcagctgcccgcaaatatccgcaagcgtaatctcccctataccgagctcctcagccgtttcagacagcggcagtgcgctgattttctcttttacgtccgcgcttccgatctgatccgcagtgagctgcagttttttgagcagcgcctttgtctctttatagctttccgggtgtatcccggtgcggtcgagcggctcccgtcctccgggcactctcaaaaagccgatgcactgttcatatgtttttgcgccgagacgcgggatatctttcagctctttgcggtttgtaaattttccgagctcttccctttttttgacgatattgccggcaacggttttggataacccggctacatattgaagcagcgcggctgatgctgtattgacattcaccccgacttggttgacgacggtctctacgacaaaacggagagattcgtttaaatgcttttggctgacatcatgctggtattgcccgacaccgacggatttaggatcaattttcacaagctcggccagcggatcctgcaacctccgcgcgatggagacggcgctgcgctcttcgacctgaaaatccggaaattcctcacgggcgatttctgacgcggaatacacgcttgctccggcctcattgacgatgacataataaatgtcccgctctgtttctttcagcacatcaacgacgaattgctctgtctcccgtgatgccgtgccgtttccgatcgccacaacctcgacttcgtaccgatccagcaattctttgattttttttcgggcttccgctgtctttttgacgggagcgtgcgggtaaatgacatcgattttcagcacttttcccgtctcatcaacgactgccagtttgcaccccgtgcggaaggccggatcgacgccgagcacgacttttcccttcatcggcggctgcagcaggagcttacgcaggttttcagcgaaaatatggatcgcctgcgcgtctgctttttctgacagttctttgcggatatcgcgttcaatagccggctggatcaggcgtttataactgtcctcaatggcttctttcagcgtttctttcacaggtgtttcacggtgtttgatgatttgcttttctaaataagcttttatctgatcggcgggcggttcgatcgcaatctttaaaatgccttctttttcaccgcggttcatcgcaagcactctgtgaggaacgaccttttggatcggctcttcgtactcgtagtacatctcatagacgtttttctcgtcatctgcggctgacttgcctgccgcggaagtgagaattccttttttatacgtttcctggcggatccactttctgaaatgaggatcatccgagatttgttcggctatgatgtgcttcgcgccttcaatggcttcctctcttgaagcgacttctttttctgcactgatatattgatcagcgacgtcgtgaaggcggttttctttcgggagagaaagaatatagtccgcaagcggttcaaggcctttgcttttggcgacggtggcttttgttttccgtttttgtttgaagggcggtataaatcctcgacttcctgaagcttgaccgcttgctcgattttttgcttcagcccgtctgtcagcttgtcctgctcggagatcaatctgatgacttcttctttccgctgcgtcaggttttgtatgtattgccaccgctcggagattgcctgaatctgcacctcgtccattgagccggtctgctcttttcggtaccgcgcaataaacgggacggtattgccgtcttccagcaggcggatgacactttcgacatgtttttgggataacgctgtttcttcagcaatttgttttttcaaaagggctaacgtttccatatcacaaaagcctccatctcttctttctttctctagtgtatcaaaaaacggcggaacataaaaaaagcagccttacgataaaagctgcccgagaatataggtcaaatcatcacgtctggatgttgtgtacggatgaagtgattttgatatttcttctattgagtgtccctgctttaagcaggtgcggatatgcggaacctcaagcccatccgtgtagatgatgaatgtcgcccctttttcgtatgatgacgtatacgttttgtatctttgcggtttgcctgagaggtaacccgaaatcggcagcggatgaaaaacttcgcctgatggggagtgcaggaagaaacggacgttgccgatcgagcagtatgtcaattcccttttgatgaaattgatttttaagatggaggcagtcgcccctcttttgtttttcatcgcttgattgcagcgctcaatgatgctttccacatcctcatccgcatacgtttccacgatgtctttaatggctgacgaggattcattggcaagagatccgctgccgagaccgtccgctaccgcgcaaactaattcttcttcattcgccttcataaaaaagctgtcgccgcatatggacttgccttctttatttaattggtatacaagagtttgaacatgttcattttcttcaacctgaatcattacattagctccatggagggatctccaatcaaggcctctctcagttttttcaccgctttccgctgcaggcgcgagacgtgcatttgagatattccgagaatgtcccctgtttctttttggcttttattttgcacaaatgttagatcgataatctgtttttcgcggtcggacagcacatgaagcacgcttttgatcatcatctgctggttgacgcgttcgtatccttcctcctgcgacccgacgatatctaaaattgtgacggtgcttccgtccgcatccgcttcgatgctgtgatcgacagaaagcgcctgatagctttttcccatctccatcgtttcaagcacttcctcttctgacacatcgagaaaggctgcgatttcttcgactttcggcgaccgctgcgtctctgtcgtcagctgatccaccgccattttaatgcgcggcccgagttctttaatccgtctcgggacgtgtacgctccatgttttatctctgaggaagcgtttgatctcgccgatgatggtcggaatcgcaaatgcttcaaaggatttgccgacctcgggatcataccgtttaatggctccgagaagtccgatcatcccgacttggcggagatcttcgtgaaagctttttccttttgaatatttctttgccagcatttcgacgagattggtatacacctcgacgagtgtttcctgggcttctttattatcatgtgtttgaaagtcgcgtatgagccgatcaacttcatctttagttagtttcgtagtttttgatggttgtgccatgatcaactcgctccccatttaaatactttgtcatcgccacggttacgccagagttgctttgaactttgacttcatccatgagcgtttccattaaatacagaccgagccctccttctgacaattgatcgactgtgtgcgaaggtgtgtacggcccgagatcctgctgcttctgatcaaaatcaaagctgtctccctgatcggcgacaatgacctccagccgatcctcaaacacaccgaaccgcacggatacttctcccttattttcatctttgtatgcatgctggacagcgtttgtacaagcttcgctgacagcgatttttaaatcttcaatgtcatcataggtatagcccattctgctggcgactcctgataatgtaagcctgacgattcctacatattccggttcggccggaattttcatctctatataatcaactgatgtactcattgcacgccaccttctgactttgccgaaatgtcgatgatgtccttaagccccgtaatttcaaacagacggacgagccggtcggaaagattctcaagcttcagagagccgccttccttgctcaccgttttaaacacgcctacaaaaacacctaaacccgtactgtccatatagtttacatcttttaagcagattctcatgtccttcccctcgtttgccaggggcatcagcttttcacgaaccaccggagctgagtatacatcgatttctccagcgatattgatttgtatatctgaaagattctccttcatatctaccgttaaattcatcgtatcacctctgaaagttatccttactcgtgctaatggctttttacccgtgctgccgtttttttaaacctttcttttcaaaacaattaacgtaaaatcatcatgaagctgaaagtcctgaagtctcagcaggctgtcgtaaatatttttgaccatatcctgcgcggagcagtccatatgttcttccagcatgcgctgaatgtcgctgcgttctaagaaaccgttttcggtacggcattcggtgacgccgtcagaaaaaagaacgatcatgtctccttcgtccatgtgctgttcatattggctgtaatcaaaatcctgggaaattcccagcaccaatccttttgcctccagatcataaaactttttttctttttcagagtagtagaagcccggttcatgccccgcagaagcatatgtaaattggtgatttttcgtattgtagtttgcgtaaaacatggtgataaacatgcttgagtccacgttctgttctacaacgcggttaagatttttcagcacttgggaggggtgaatgccgatctccggaagagagtccatggcatacttgatcatcgacatgcacaatgcggcgggtattccttttccgatgacatcggctatcgcgatgttaatcgattccttgtctttgacaaagtgataatagtccccgctcatttgcttggcggggacgctgatcgccccgatatccagttcttcttcttcaggaatttttgtgcccagcagcgtctgctgaacatttgcggcaatttcaatttctgaacgaagctcctgctggatatctctcagactttggtgttcctgataagccatcccgtagccaatcatgacttctattaaaaaatccagcgaatgaaaaacatcttccggcagatccggatacagttcctttaccacttttcggtggatgctgatgatctcctccggaggaacctgatgttcaatcgtttttcggctgaatttttgggcttgatataaagatgtttctgttaattcggctatatatcggctaagcagctgatgataccgctgctctataacctccctgaaatccacgttctaacctcctaccgaagccattttacggcttgaatctctgttccttcctctgcaacagattgcaggctgaattcgtccatcagccttttcacgcccggaagtcccgctcccagtccgcctgacgttgaaaagccgtcttccatcactttacggatgtcggggattccgggtcctttgtcttctgctataattttaaggccttttttccctctgtcgtttacttgttctatgctgacctggcccttgcctgcatataagtaaatgtttctggccaattctgagatagccgtcgtgattctggcctggtccaccgtgccgaagcctaattccttcgcaacgttgcggccaagctgtctggcggctacgatatcccattctgtcatgattttcacacaggattggtcgttcatcgctattcccccaattcccgcttcaatgtctcaagcccttgctctaaatcgagcgccgtttcaatttcctcaagtgagattccgagttcaatcaatgtgaccgccacagccggctgaattcccgtcaatacgacctttgcgcccatcaatttagacatggtgatgacatcgccgagcactttcgcgataaatgaatcaatcatgtcaacggatgtcaggtcaatgacgaccccgtttgcgccggtttcatagattttgttcagcagatcttcttgaaaatgcaaagctgtctggtcgtcaagctcccattggatggataccaataagcagttatacagtttcaggatcgggatttttggatgtctcacaatgttattcccccaatgaaacgatttttcgatttgtcatttcaagcgctgtttgaattcctttttgaagggtattcttcgtaataacctgcgacaaatcaattcccagattaacgatcgtctgcgcgatttccggacggattccgacgagcagacatttcgcgccgacaagccgcaccgcttctgatgcctgaataatatggtgcgccaccatcgtatcaacgaccggcacgcccgtgatatcaattaatacaacctgtgaacggtgctttacgacgccgtttaacagattttccataatatgctttgcacgctccgtatcaatcgtcccgacaagcggcatgaccgttacatgctcaaataccgggatcagcggagccgacaattcctgaagcgcgattttttgcaaagtaaccgttttttcccaggagatagaatactgatttaagatttccgtgttgatcggattgaaaaagctgtctatttccaaaatcaaatctgctctgtcctgatcggccatattaaggtcgaccatcgtttcgtaaagcagtttccaaaactctgacagggtggctgaaagaagtttcagcgacaggccgagctgaacggcgcgcagtgcgagttcactgatctgctcttcggcagcctcgtcattttttgtcgataataaaagaatgtctatataatctttacaaatattttcacatatgtgattcgtaagctgatagtcttcctgattgcctacttcttttagtttggctgtccaagtatcaagcagttcatcatgctgatcaataatgaactgatacactttctgattcgacatgggtttcactgacctcccgacacaaaacaacaaattttgtttgattatttctttattatagcgcttatgtttttcgaaaacaaaaaaagttgctctatatgagcaaccaaaatatgactaaaaatcaatgagtgccaaactgatttgcagggcttcatcaaccttatccatcatttcatcatccagatgagttattttatccgttaatctttgcttgtcaatcgtccgaatttgctccagcaaaataacggaatctctttcaaaaccgtagcgttttgcatcaatttcgacgtgggttggtaatttcgctttctgtatttgggctgttatggctgcaacaatagcagtcgggctaaagcgatttccgatatcattctggatcactaaaaccgggcgtacgccgccttgctctgagccaacaacaggagataaatcagcaaaataaacatcgccgcgctttacaatcaaaatgattatcctccgctgactaagcgctcaacggtcgtttctgcttcgcactcagcatagtgagcctcagaagagatattcaagttgattttcgccatttccatatacccgcgtctcatcaaatcacggttatggcgagttgtccgttcgctgacatacgctctcactgcttgtgatatcagttcgtttctgcttcgtttctcccgcatcgctacaccatccaattcagctactaagttttcgggcaagctgattttcatttcggttcttgcgctggattcagacaaaaaacatacacctccaccaaacttacggatacgaccaattcatccatccagacataatgataccattattcaaacgtcaagcaaagctgttttataaattctctttttccggatgacggctacttgtttgtattatcttgcagtaaaggatttcttacttccattatactctcattttccaaaaacatacggggaacgcgggaactaatggtacaagggacctcgtaattaatcgtctcaagccgccctgcgatttcatccatcgtgatcgtttcttccttctggctgccgatcagggtgactttggtgcccggcggataagattgatctaattcgaccatcaattgatccatgcagattcttcccgcgatgttcatccgtttgccgccgatcagcacagacgtgccgctcagcttgcggagccacccgtctgcatagccgatgggaaccgttccgatccattgatccttctctgccgtatatgttgcgccgtagctgacgctttcccctttgcggatctttttcacatgggataacacagagtgcagcgcaaaagccggctttaattgaaacggaatttcgctttggatgtcagcagaaggacgaagcccgtacatactgatgccgaaacgaaccgcgttaaagaagccttttttaaggcgaagtccggcggcgctgttcgcgcagtgcaccatcaattcttttaaagggagcggagcgatcaatgttttaaagcggtcaaactggaagaggaaataatctctgtttttctcatccgcggtagcaaagtgggtgaaaacgcctttacagactaaaccgggattttggctgaggatttttaacacgctttggatttcttcctccgttttgactccgagtctgttcatgccggtatcgactttcagatgaaacggcaatgtggcacctccgaggtggcgcgcagcttcctgaagccattcaacagaatatcccgtgagtgttacgtcatattcggcagctgcttgtacatattcgggcggcacggcgccaagcacaagaatcggcgctgtaatgccccgttttctcaatgaaatcgcttcatccagtatggctacggcaagacaagaggcacccgcttcaagcgcggctttcccaacttccaaatctccgtggccgtaagcgttcgcctttacaaccgccatgagatggacgttttgcccgatgtgttttttcatatgcgtgacattttctttaatcgcggacaggttgatttccgcccacgtttctctgtaaaaggatgctgtgttcattcgatacacttcctagcattattttcaattcatattgttattatcatactaaaattattctgcaaagtgaaatggaatcaaaaaagagaccgacagcggcggcctcttttttgacattattttgacgactgtccctgcatgcttttggcggcggccaccatttcatcctttgtcagatcctgtgatgacagaagataatccactccgtcatatgtccacgttaaagacgtatcagataatgcggccaccgtgaagccgagattaaccggttcgcctttcagcgtgacggcagaggcggcttttgcgatatgggctttttcttgaataagggtgaaggatttttctccgccgtaagtcatgacgatccgtttgccgtccgccgttgaaatatctttctcttcaagctttttgacgccggccggcacttgaagcggtgttttgaccgcaaatgaatcagacggcttggcgcttgtggcgacgtccatctgggaaagcgtcatatttttcttctcgtcaaaagagtctttatcaaacggcttgttgaattcaaagcttttgaattcgacttttaccatcactttccggtctgtatccatgactttgacgagcgaagggctcatgtcctttttgttgaaagtgatttcctgagtcggcagcattttgttgtgctgatagtttgtttttgtttcaaacgtgtactttttatctttggcggaatagacggcgtctttgtcatgctgcacgtcctttacaagtgactcaaacaaatatacttggctgctgttattcggccagtcgctttggaacctgaagctcttatttaaagacggcgtaaggacaaagactccgttggcgttccgtaaaatgacttggttttggtcttttttcggattttccagatagacccggtacagggaaggttttttatgccagatttccacattgtatacttgcggatcactccccgtctgaatggtcattttggctttcgctttgtacgaggtgtattctttcgccttcttatctaaaccgttcacgatatcttcctgtgatttttggccgcaggccgaaagaataaggacggcaagcagtcccgttaaaagcaaaacaaagctttttctcaccttttttcaaccccttcttctcaattgatgtaaagggaagaaatcgcttgtttgactttaacggtacgccctgaacggacggacgcgtaccataaaagcctcaaacaacttgtctcccttaatgcactatcaaatatatgaaggggtttcggctaatatgcagactagcgtgacaacctttcaatcacgacctgtgccgcggcgtattcttttgtatgggtaatggagacgtgaaccgccgcgccgtccagcttggcgcaggtcagcaccggcttgcccgccgtgtcgtttccggtttcgatatcctgaaagctgagctctttgccgatacccgttccgtatgctttcgaaaaggcttcttttgccgcaaatcttcccgcgagaaattcaattttccttttgtccgacagcaatgtaaaacgggcgtattcagcctccgtcaatattctttgcggaaacctcgcctgccggctgagcatgttttcaattctgtgcagttcaacgatgtcgattccgattccgaaaatcatgtgaattcctcctaaaagtccgtactaaaaaacggtttatgtcataaacgtgttactatatatgtaacaaatcagatgcaaaggggcttgcgatgtttatacgtacggaaaatttccagacttttatcagacgttatccggccgtcagctgtatcttggcgctgcaggcgttcttgtggctgtttttcagtatgccgcttcattccgtcatgatgtggtcagatgcagtgaccggctataattacggcgtttcctcgggagaatggtggcggctggtgacaccgatgtttttacatgcgaatttcactcaccttttgtttaactccatgtctctctttttattcgcgcccccgctggagcagatgctcggaaaagtccgttttttgattgtgtacatcgcatcgggcattatcggcaatatcggcacatatcttgccgaaccgcttgattatgtgcatgtcggcgcatccggcgcgattttcggacttttcggcgtgtatgtgtttctgactgttttccgcaaggagctgatcggccgggaccagtcgaaaatgattatgaccctgcttatcatcgcggtactgtcgacgtttatcaattctaatattaacattatggcgcatttgttcggactggcaggcggatttttgctttcctttttatgcgtgcagcaaaaaaagcggcggtattaaccgtccgctttttcatatgaataccagcgcccgatgcgttcggcatcttcctcgctgacatccttcagcatgacatgctccatgtggtgagctgatttcactgcggtagccacagatgcgagccgccttcttttttgcagaaaggagcggctgacttcaaacatctgcattcttcttctcagcataatcgtggtcgtcttcccgatcagccgtgtggtgagctgcagccggcctccgtttaagcaccatgacgcgctcttaaatgaggcgtagcccagcaccagttcgacgggaagcacaaggagcgatgcatacccccacggtttaaacagaatacaaagcggaatgatcacgaaaaccgagaagataacggagcggaataaataccggcgcagcgcccttttcggcaaatgattcctattttcttccagtacgtaatccggtgtgaaaccgttcagcatcacaccgagctttgatttgcggatgatcggaaacagaatcgtctgagctccttctttctcattccccgcactgccggcgctgacaatcgcaaccgtcgcgtatccgaataactgcctgatcacattttctttaattttaatggcttggattttacggagcgggatggtcacttgatgtttttcaataattcctctcgtaatgaccaattcgtgttcctttttttctatcttaaagttggcatgcttgatcatcataccggcgatgcttaacagccaggcgatgaacaatcctataaaaatgatcacggcgtatatgccgatgctcgcatgcttgagaaaagaaaacctgtcgtagaaccagtccatcggaagtacttcatcaagctgagaaaagagggcgaataccgctgagatgatgacaccgatccccccggatgttgaggcggccataagcagctcacccacagacaggcggtaaacggattgcacatcttccccgcgcatcggctcctgctccgctgcggtctcccctcgttcttcttgctccgctttttgctgaaaaacagccgctctgatccgttccgcctcttccacagtaatggcggataagacggcctcggcgtttttcccgtcgccggccgtttcgatttgaagcttaacaagcttaaaaagctgctgaacgatgccggcactcgtattcattgattgaatccggtcaatggagatgtatctctttttcgtaaaaaacaagccttcttcaattctgaattctccgtcctcaatccggtatgtaaattttctccactcgatcacacttgccgtaatcagccagataagcaggacagcgagcgcaatgcctccgtaaaagcggatgaagtggttggaattaacaatatagacgagaaaaaatggcagaataatgtttttaatggtttcgataataatatggaataagttcaaaatcacggccgccgggtgcagacgtttcggttcagacatcatcttccgtcacccttgccagacgggaaatggaatccctcagccggtcagcttcctccatatcaagcgccggaatggaatgaacggttgccgccgtagagattttgactgaggccaggcggtaccttctgaggagcgggccttgtgaagtatctacgtgctgcaccctcaccatcggcacaatgacccgtttgactataaaaatgccggattgaatatcaatttcattttcatggacctcatagcgccagatcctgtgcctgattttcggtatggcatagacggatatcactgaaccgatgacccaaatgatgccgaggactccggtgatccaatacggccaatggaagaaatggcttaaaacagctgctgctataacggccagaagacagaaggcggacaggatgatttcctgaagacgccagacttttaagccgcttggactgattcgattttttggctgtgctctcaacatacctacctcccattttttatcatacatacaaatacggctgatttgcaaaaaagattcactttccggcatatcgaaaaaaagcggaccccgaaaaagggtccgcttcctgtgttttagtatgattttttctggcgtctgtcacctgaagaacggcggtcgcttgagcgttttttatcgtaggaagaacggttgttgtttttccctttgccgccgcggtagccgccgccttggccgtctctgcgcttagaagtacgctggtttttatagcgtttgctgaccatcggcgcttcatcagtgaggcgtacaggcgtgctgtccggctcttttgtcgccattttaatggctgcagccacaactgtcactgcatcatgatcttctaacaattccgcagctgccgtcatgtagaagttcaggttgttttcgctgatcgccgtgcgcagacggtcaaccgtcacctgctgctgaccttctaatgcttcgtcaagcgtcggctctttcatgcggtccattttgcgttttgtcgtttgttcgatcgcgcgaagcatgtttttctcacgcggtgtgataaacgtcatcgccatacccgtttttcctgcgcgtcccgttcttccgatacggtgaacgtaactttcaggatcttgaggcacgtcaaagttgtatacgtgggtaacacctgagatatcaagtccgcgggcagcaacgtcagtcgctacaagcacttcgatcgcaccttctttaaacttgcggagcgctaccatacgcttcgcctgcgttaagtcgccgtgaattccttcagccgcatatccgcgaaggttcagcgcttccgtcaattcgtcaacacggcgttttgtacggccgaatacaatcgcaagttccggagactgaatgtcaagaagacgagtcagcgtatcgaattttttgcgctcctgcacttccaagtagaactgctgaatgttggacacagtcatttctttcgcttttacttttacgtgttccggctcagtcatgaaacgctctgcgatccgtttgatcggcgcaggcattgttgctgagaataagagcgtttggtggtcgctcggcacgtttgagagaatggattcaatatcatcaatgaatcccatgttcagcatttcatcagcctcgtccatgacaaccgtgttcacgttgtttaaacggatcgtgcggcggttgatatggtcaagaagacgccccggcgtacctacaatgatatgcgggtttttcttcaatgcgcggatctgacgtccgatatcctgaccgccgtaaataggcagcactttcgcacgcttatcttgtccgattttatataactcttcagatacttgaatggctaattcacgggttggcgcgattacgattgcttgaatattaggagactcggggttcattttttcaacaaggggtataccgaacgcagctgttttacctgtacctgtttgcgcttgtccgatgacatctttatttaaaagtccgagcggaatcgtttgtgcctgaatcggtgttgcttcttcaaatcccatacgattgattgatttcatgagatcagaacttaattggaaatcttgaaacgttatagtcaaattattcaaactccttctgattgctgtttcagtaatgtcgtgatttaccactaaaaactgccctttcatccaaaggacaggatcatacgtatacaaagcccgaattactttacgtttaatcttaccattacactatgtgtttttcaataaggcgagatggtcaggcggccggaagcggcctgaccggattcttcccgcaaacgaggccggaccccgcgccggacgggatttcccagccggcggcctttctttttcatacggacagaattatttcaccctgaattagtttcttcatttttgtatatttttataatgctgatcagtattttttcagttcttctctaataaatctttaacgatttcttcgagcttcatacctctcgatgctttaaacagaaggagatcgccggaagcggccatatcctgtatggcgtgaagcagttcttttttgtcgagataatggctgacgcgcccttcttcaaaatgccggcgcgctccgtctgcgatgaatgcgccgagtgtgccgtaagtaaatacatggtcaatttccgccggattgatcgcagctccgcattcttcgtggaatgctttttcttcatcaccgagttcaagcatatcaccgagcacgagcattttcttccgatagcctttcatcgtttcgattaattcgaccgccgctttcattgacgtcgggctcgcattatacgcgtcgtttacgatcgagatgccgttttccgttttaaccagttccaatctcatccccgtcaccttcaggcggctcagtcccagagcggcattttccggcgtaatgccgaaatagatgccggcggcgtatgcggccatggcattcatcacattatgtctgccgagaaccggaataaagaaagaacgttcgatcccgtcgatattgaagtacgtgccttcttccgcctgttttatttctttcaggcggagatcattgacagcgcctgcgccgtatgtcgttgtccggcaagtgtacgccttttcgcggagcaacggctcatccccgaaataaaacagaacgccgtcttcccgaagtccgtttataatttcaagtttcgcctccgcaattccttctcttgagcctaaatcctgcatgtgggattcgccgatattggtaatgacggcagcttccggttcagcaagacggctcagaaaatcaatttcgcctctcgcgctcattcccatttctaaaacggcgatttctgtatcttcaggcatggcaagcacggtcagcggcaggccgatatggttgttgaaattgccggcggttttgtgaacacggtactgagtgctgagaacggcgtgaagcatgtctttcgttgtcgtttttccgttgctcccggtcaccccgatgacccgtgtgccgagttctttcaaataagctttcgccaatgtctgcagcgcctccagcgtgtcatcgacaaggatgacggcacgctcttccggcggattcggttcagagcggtcccacaacaccgcggaaacgcctttttcgaatgcttgcggcacaaaggtatggccgttaaaatgctcgccttttaaaggaatgaacagctgatttttttccaaagtccgcgtatcggttgcggcgccctcaatcattgtttgttcaaatacaggatttgtcagtgtgcctttgaccatgtcggcgattcgttttacagttcgctttatcaaaggtggcacctcgctttctgaaaatgttgtctgttacgggaaaagacactgccccttcaggcagtgtccgtcttcattaaaatgtatgtttaatcagctgtttttcggcatggcgttcttttgccagctcaaccagctgttcgatcagatcactgtaatctacgcctgcttctttccaaagcagcgggaacatgctgaatggcgtaaagcccggcattgtgttcacttcgttaatgagcacttgaccgtcattggtcaggaagaaatcggcgcggacaaggcctgatccgtcaatcgctttgaaggctttaatcgccatctcgctgatttccgcatattgttcatccgtcacttgcgcgggaatcattaaatccgtgtcgccgtcttcatatttcgctttgtaatcgtaaaagtcggttttcggcgtgatttcaccgacggcggaacatttcggttcgtcatttccgagtacgccgatttcgatttctctgccggcgattccttcttccaccacaattttccggtcatactcaaaagccagttcgaaggctttttcaagctcttcgcgatttcggcatttgctgattccgacgcttgacccgaggttcgccggtttgacgaagcacggatatcccagctcctcttcaacctgctgtaagcagctgtccggcgtctgtttccagtccttttttaagaaagcggcgtacttcgcctgcggaagccccgcttgagcgaacaaatgcttcatgatgactttatccatgccggctgatgatgcaagcactccgttgccgacataaggaacgttcagcaattccagcagtccctgaatggtgccgtcttcaccgttcggtccgtgcagaagcggaaatacgacatcgatctgcgccttttcgtcaggcgacgcttcaggaaacatttcccggttcaatgctgatagagcgaaactttcaccgttttgttccagctgaagcattttcacgttggaaaccggctcagtcagcagcgggcctctttgccattctcctttttcagtgatgtaaatcggatgtatatcaaacttctcagtattaagcgcttttgttacagctaatgctgtctgcagcgatacattgtgttcggctgactttccgccgtacaccaatcctagacttgttttcaatggatattcccccacaacaattcatctttactatcttatcactttcctcagaaaatgatctaattatttttgggcattctgaatatgaaagcatttgtatgtaattcctttttattttatattaaaatggcatggaaaaggagatgtgtcatatgaaaaaaatcagtacaacagaacaatttaatgaacttattcaatccgacaaggaaatcatcgtgaaatttttcgctgattggtgccctgactgcacgcgcatgaatatgttcatcggcgatattttggaagaatataatcaaaatgattggtatgagctgaacagagacgagctccctgagcttgccgacaaatatcaggtaatgggcataccgagccttctgatctttaaaaacggcgaaaagaaagcgcatcttcacagcgcaaacgcgaaaacgcccgaagaagtcacagagtttttatcacagcatatttaattcgtttcacgatctttgtttatgacttcaggctctacatgaacatggacatgagtcacatcatgttcatgttttattgcatattcgacttcatcggctacttcatggccttctttcacagacagtcccggatctaccgtaatgaccatttccacatgaaccgtgctccccaaataccttgctttcacatccttcagcctgctgacctcttttatttctttcactgtgtgtttatacggctccaaatctttcagatcaaacccgtccgttaatgagtgggaagcatctttgaagatgtcccatgccgtcttacagatgataattccgatcagaaaagcaatgaccggatcaatccacggcagatgaagccgggccgttaagacgcctatcaacgccccaatactgacataggcgtcagaacggctgtctttcgccgccgcatgaagcgcagaacttttaacccgatccgcaagacggctgttatatacatacatgccgtacatgacaatcgcgcttcctagcgccgtccatgccgcaatgaagctcggctcggcctccgttccgctgacaatcgcctttgctcctccgatcagcacttcaataccgaccgccatcataataaaagacgcaattaatgaagaaattgtttcagcccgataatgtccgtaggcatgatcactgtccgcggggcgctgggaaatccggagcccgatcagcacagccagtgatgcgacaatatccgtagcattatttaacccgtccgcactgagcgcttcggaatgataaataagaccgatcaccagtttgacggcggcaaggataaggtacgcggcgatattaagaatcgcgcctttttcgccccgttttaagtttgccgtttgatcattcatgtaaggactcctccattctcattcatagtatggatggaaaagcggaaaaatagcagctttgatctgaccaaatgcaatattcgacagcattattccccgggaaactatttgtcgaaaaattggcggtatttttcctttacatatgaatatgtccattgtataatttcattaactgataatgattctcaatatcaattgattaggagggtaatcatgaggtcttctcctcagctcagatcatcagttgaaggacgaaaaaaacatctgatccatttgctgatcaataacggaatatacaaaaagtcggaacggcatttatatgaattatcgctcggagaattagaaagcgaatacaaatatgtaaggaaggtgcgggctcatggcgaaacgtaaaataaaaacatacgaacagctgataaaagaaaacaaggcggccattatgaataatcaaaagctgatgaatgtgatctatgacagaattgaccgcaagcatcaaaaactgctccggcacaacagccatacataaaaagagcctttttcaggctcttttttttattgctcaaaggcttccgccgctaatttgccgatgaccgcatcgtccatcggcggattgtgaaggccggcccgggcatcccgataataccgctgaagcggattatttcgctccaggctttttgcgccggtgattctcattgctttgtcaacaacagaaaggacggcatttgtcacaatatgttttgccgcgccgagctcgcttttgatgaaagggcggcgtttcggatcatcatacatttgcgccgccgtgaagagaaactgtctcgcttttaacaattcaagctccatttccccgacacgctgctgaacggccggcacgtctttaatcggtccgttcaggctgttcggcgaatattcagatgcaaaccggacggcatagtcccttgccgcttgagcgatgcccagataagcagcgggaatgtgaagcagccagccattcactttcgccgctctcggcccgctgataagctccacaagccgctcgtcactgaccgtgacatgatctaaaaggagatcatggcttccggtcgccttcatggcaatcatatcccatgtttcttcgactgaaacgcctgcctgatctttatgaatgagaaaaacaccggtcgtttgtttttcttcaatccatgccgtcacaagcatataatccaaagtcagtgaaagggttgtaaaggtttttcggccgttcagcacccattttccgtcttttttgacagcggaagtgccgggtcttcctcccctcgtcggactgccggtctgccgttccgtcgctgccctgttcaggacggctccctttttcacctcttttgtgataaatgaaaagacaccttcatcccagctgtttccttctccgagctcacccatgacggataaatgccagccgattccgagagcgacggccgcgtctccccgcgccagccgttcctgaaacagcaccatctcataaacggaaatgcctgcaccgccgaatgcctcaggtaccgttaacgccgtatatcccgcgtcgcgcagtctttgaattttctccgcgggaaaacggcccgcctcatcatcaagcgcggctgttttttgaaattcgtctgcaagcaggccgattttttccatccattcccgctgccgttcattctgtatccataaagacactggaatccccccattataattccgataaagttaataagtattatagagattcaagtctcgtttcgcaactgtgaggctgtacaaaaaaacgcgctattccatagaatagcgcgttcagactgcttccgggccgcggtcctgcttgagcccgagataaatcagcatatatgtgagataacccatcgtcatcacaagcccgccaaagaaaaagcttgaaaaaatcggctcttcaaacgcggtaaccgccgcaagcacgatccagcttgcatacaggtagatgatgaaataacggaatcccgtcttcattttatataagagaaacagccccactgtagaaaacaaacccagcgcaagcctgaaataaacaagatgttcgaattgaaacatgaatgacacaaaggaaaaaccaagcaataacacaatcggtaatgcggtaataaaatttctcaagtgagcacctccgtcattacctttattataaatcaaaatagcataaattattgatttatcgtgatctttttcacaaaaatgtcattcctttactttatacccgaatatcgcgtttgcaaaagctccaccaagcgacggctaagaagaatacgatatggataatgataatgcctgcggaaaataacggcgtcattcccgcaaacagcggcttcgccccgctcatatattgcgtcaggtcagtatttgcgaacagcagaaaactaccccatttgttttggaagagcgacataatcgtcacaagtgattttgcgccgtacagcacgataaatgacaaaatgacggccgttgcgctgtttcggaatacagaagaacacaacaagccaaagcatgccatcgcaaacgcctcgacccagttcgtgccgattactttcagggtgttcacaagaagcgtccctgattcagatgtcaccgacactccgaagaaagccatgccgaacagcagagacagaatatagtacgccgcatacaggtacaagctgaccaaaaatacggtaatgagtttagatacaaaaatccgctcccgctttaccgggcggattaacaaaaatttgatcgttttcttatcaaattcagcggaaatgatcgttgccgcgatcacgatcgttaatgcctcaagcagaatattcagcccgggggcgtacgccatatagccgatgaaattctcatccgttccggaactgatgacaagccgtttaatgacaagcgccataataaattggagaacggccatcagaatcagcgccactaatgagacttttcggttaaagagtttcatatgctcattcgctgtcaatttaaacattcgtcttcccctcctcttgaagcgccgtcgtcactttcatgaattcatcctccagcgattccgcatacggcatgatggaatacacgagaaagtcttgtccgacgagcgcacggtttaatgccgggatgtccttcttcgctacggtgacggtaatgctcccgccgtttttctccggaacgaattgctgctgggacagccattcgaaggcttcgtcagccggctgaatgtcgaggatggctttttcttctttttccgcagcgccgcgcagaacaacctctgttttgatctcacctttttgaatgatgatgacacggtcgcaaaggtcctccacttcacgcaataaatgcgtcgcaaaaaggatgctcgtcccttcaagctccgcgagttcctttaagtgatcgcggaaatccttcattccgccgggatcaagcccgtttgtcggttcatctaaaatgagcagattcggacggtgaagaatggcctgtgcaatcccgagacgctgacgcatgccaagggaatacgttttaactttgtcatgaacggcatttgtgagcccgacccgctcgatgacttcctgaagcctgtcttctgtgatgtttttgtgcatgttggcaaagtgcttcagattttcccaccccgtcaggtacgggtagaattcaggattttccacgatcgctccgacggattcaagcgctttttcgaaatcagcatcgtgctgaaagccgttaattgtaatcgtgccgctgtttttctttaaaaggccgacgatgattcggataagtgtggtttttcccgacccgttcggaccgagcaaaccgatgatctcgccctgcctgacatccatgctgatgttttttaaaatgtgctttttgcctattgttttgtcaaggccttcaatatgtaaaatcggctcagtcatacagccttcctcctttttcacaaaaaataaacagtgcccgtacataggcactgtctgcattataacattagtcatatattcgtgaagagccggagccgtcgttatgtcttatccgggaccggtccgtttttttccttctcctcattattgacgacatccagaatatcaagcaggaacacaaaaatcggaattccgataatcaagccccaaatgccgaagaaatgttctgagaaaatcagaaccgtaaaggtaaaaaagatcggcagttccgtttttgctgacatcagtttcggattaaggaagtacgtctcaatcgcatgaatgacgaaaatgaccagcacgatgtagatgacgtacgcagcgccgcccgtcgtatacgcgatgatgctgagcggaatgagcgaaatcaccacacccgccacgggaatgagcccgaggaaaaagaccatgatggacaggccgaacagctgcggaaaatgcagaatcgccaatgcgatcaaggtgaggatacagttcaccagcgcgataataaattgggcttcaagcactttgccgaatgttctcgcaaatttgctgccgaaataagcaagttcgtagtaaaaaacagacagcttgctgtgctgaaattttttcataaactccgtgagccgctttttctcgaacaggaaaaacatgctgagaatcagtgacatcacgacctgcaaaccgaaagtgctgatatcggccaagtatgtatacagtacattaaaaccttcttttacataggaaccgatattgatatcgccgaacacgctcgatatctcatcataaaacggaatgacatcgggatgatacgcgatgtgcttgatctgcttaatcagctgttcaatctgcttggcaacaatcgggtaaaagacaaagcctccgacagtcgccccgacagccagcgcaatatataaaatggtgatgaccaccctctggctgatccggaaaaaatggttcaacacgtgccggatgacagtctccagccgatccatcagaaaagtaaaaataaacgtaagcaaaatcaaattaatcatacttcggaatacaactaacaccccagtcaaaacaagaaaaacggaaaaacgtctgacacccggatgctgaaaaaatttaaaaatagccgccatttatacactcctgctaggacaaaaagcccttagatttcatctttcactctctaattgtaaattatataacaaaatgacgctaaggtctttgtccacctcctaataaatttaaacaaatttatcttttttactcatggcggccgaaaaaaagaacggcatgccggatgcatgccgttcctttccttttataccgccgtttttatttcttttacggcctgtgtgcttttcgcttcgtcaaactcattttcgctcttggctacgatgatggtggcgattccgtttccgatcaggttgacgatcgcccttccttcactcataaagcggtcaacgccgaggagcagcgccagtccctccagcggaataacctgaagcgccgataaagtggaggcgagcacgataaatccgcttccggttacacccgccgcgccttttgatgtcagcatcagcacgagaatgatcgtaacctgctggccgatggtaagatcaacgccgaacacctgcgccagaaaaaccgtcgccatggacagatagatcgaggtgccgtccaggttaaaagaatatcccgtcggaatgacaaggccgacaaccgatttggaacagccgtaacgttccattttatccatcatccgcggaaggacggactcagaagagcttgtgccgagaacgatgagcagttcatctttaataaaacggagatagttccacaagctgaaaccgaatagtttgcaaatgatattcaaagcgacaaatacaaacaggaacatcgtaacgtatacagacagcatcagactcgccagcggcttgatggaatcaaggccgaagtgcccgatcgtataggccatggccccgaatgcgccgatcggcgccgcgcgcatgatgtagccgatgattttgaaaaaaacgtgcgacagtttatcaaagaaatcaataatgcttttgcctctttcaccgagcgccgccaggccgacaccgaataaaacagaaaagaataagacctgaagaatgtcgccttttgcgaaagcgtcaaccatatttgacggaacgatgtgagtgataaattcaatccagtcaatcccctgtcccccgttttgggtgtactgagagacatcccctttttcaagcttgctgtaatcaaggccctcaccgggtttcatgatattgacgaccagaagcccgataataagggcgatggtggtcacgacttcaaaataaataaatgcttttcccccgactttgccgacttttttcatgtctcccatcttggcgatgccaagcacgatcgtcaggaatatgatcggtgcgataatcatttttaccgcattgataaatgtatcgccgagcggcttcatctgcttcccggcctcaggccaaacgagtccgacaatgacgccgatgatcaccgccgtgatgacctgcaccgtaagatttttgaaaattttcatccctactcccccttgcctctcgatgcgtctatacaaagatgatagcgttttcatacgaagaggggaagcttatgatcataacggacattttggtctttttggtctcggctagcggacgaatttgtagcggttaaccggccgtcccactcccccgtattgaatgtcgagcttaatctggccgtccttctcaagaaaatcaagataacgccgcgccgtcacccttgcgattccgagcgctttggcggcttcttcagctgaaagcggctccgtctgctgtttcatataggtcaaaatttcattcatcgtaaaatggtttaaccccttcggcagatcccgggacggattttgcggaattttcagcagcatgtcaagctgctcttgcgacatcgtgtcatgctcttcaattttccgtttatattgtttatagttttcgagcgcctgtctcatccgctccagcttaaacggcttcaaaatatagtcggccgcaccgttttgcagcataagctggattgtttctttgtcttttgcggccgagacgatgatgacgtccacttcgagcttttgttttctgatttcctggagcgttttaattccgtcttttttcggcatgtatacgtctaataccacgagcccgggccgcagatcttttataagcctgattccctcgtctccgtcagcggccgtggcgatgacgctgaaccctgaaacaccggtgataaattctttattcacctcctgcaccatcggatcatcttcaataagcagcaccttgatgtccatcgaatgattcctcccccttcatcggaaataatatagaaaatgccgttccctgtccctgccgtgtgtcgacttcaatcacgcccatccctttgtcgacgatttgtttgacgaggtacaagccgtatcccgttcctcccgttttattgacggtaaaccctttgtcataaaggcgcgggatatgctgatcggaaatcccgcttccgttgtcttctattaatatagcaagcacttcatcattttgctcgatactgatgtcaatatgtttgtcctccgtgtccgctgtttcgaatgcgccgaacgcattttcaattaaattgccgagcaggacgacgatgtcatgctggtcgacatgctccggaaatgccgagaaactgctgttttcatcaattttcacagaaatgccaagctcttttcctcttttgattttgcttaacagcagccccgccgcggcgtcattctgaatggcctgatgaagaaaatcagtgacgctttcttgttctgatgattccttaaaagcaagccggagcgctttttctgattttccgagctgaatcagccccgcgatggtgtgaagcttgttcatatgttcatgattttggactctgagcgcatcgacaaaatttttcacacctgtcagttcttccgccattttcgccgcttccgtcctgtcctgaaaaatggcgacggctccgatgaccttctttttcatgacaatcggaattctgctgctcatgatcacctttccgctgacttggatttcttcattatatacggctcggttccgctcgacgatttcagggagccgcgaatcttttaacacgtcccagatcagcctgccgtcggtctcttgtctgacattgaatatctgcttcgctttttcattaaaaatggtgatgtgatgctgattatcgatcgcaatgacgccctcattcatcgagtgaaacgtagcggtccgttcctcatacattctcacgatctcatggggctcgagccaaaacatttgttttttgatgtggcgggccagcaaaaaggagccggccagtccgaacccgagcgccagcagaacgataaacagtatttcatgtttcagctgaagaagaatttcaccgaatccgggcagcgttttaccggcaaggacgacgccgatctgattcaaatcccggtctttgatgggataaaaagcgcggacggcggtgccgatctctccctttgcttcggaaaaataaatgtgctcggcgaacgccgcggcttcgtcctcaccccttgaacgctttccgatcattgtgctgacgggatgtgaatagcggatatgatccatatccatgacgacgatgtagtccgcttcattgatgatccttatttcttcgaccgcatggcgcacgtcttccctttgttttttctgctccagggcgcgtttgacatcggtcatctcagataccgtccgcgcggtattcatcagccgttttttcagctcgcgctcctctgtatgctggatattgccgaccagcacgatgccgacgatcaaaaaggtaaaaagcacgacgatataagaaagtatggtgattttccagcggatggtaagcttttttttcgtcattggcctcttcctttccgtctctttacgaaaacggcccgcccgattatgcttgttatagaaaatggcggagggggttttcgatgaaaagcttgctgacttgtctcagcctgatggtactcggtatcggaaccgctttattcatcggctttcatgatcgtttctcaacagaagaaccgtattatgatgacgaacaggaaggcctgaaagatcaaatggttttcaaattcagtcatgtcgtggctgaaaacacacctaaagggcgggcggcgaataaatttgccgacctggtctatcaaaagtccggcggtaccattaaagtagaggtatttccaaacgggagcctctattcagataatgaagaaataaacgccctccaaaacggggacgtgcaattcatcgctccctccacctcaaagctcggatcactgtctcccgaatggggtgttttggatctgccgtacgcgtttacaaactataaagccgtgcaagaaggcctcaacggcaaaatcggcacgcgcctgttcgcttctttagaaaagcatcatttgaaaggactggcgtactggacgaacgggtttaagcagctcacgtcaaataaagggccgatcttctctccggacgatttgaaaggacaggcgctcaggatcatgccgagcagcgtgatcgaagaccagtaccgcctgctcagcgcgcacccgcggcaggattcctttaattccacgtttcagctcttggaaagcaatctcgtagacggagaggaaaatacgatttcaaatatctattctaaaaaattttataatgttcaagattatttgacaatcagcaatcacgggtacctcggttatgccgtgatgaccgacgagcatttctggaattcacagacagaaaaaacgagaaccatcttaacggaggcgatgagagaaacgacggaatggaacgaagcctccgctgagaaaatgaataaagaccagcttgaagagataaagaagaattcatccattcatattcatgtgctgagcaaagcggaaaagaacacatggatgaaacgcctcgacccgatttacggacaatatgaacaggtgatcggccgcgggcttgtgcaggatttgttatccttgcgccgcgagccttagcaggaccaatacgcccatctccgtttcatcccttttcccgccggggaagtaaatagggacagagcaaaaaaggagatggagacatgtttacacatacgaaaaaactgcagcatccggctaaaccggatcgtcctgacccgctgttcgcaaaaaagatgcaggaaattttagggggacaatacggggaaatatccgtcgccatgcaatatttgttccaaggatggaatacacgaggcaatgaaaaatataaggatcttctgatggataccgcgacggaagaaatcggccatgtcgaaatgatcgcgacgatgattgcgagactgttagaagacgccccgctggcagagcaggaaaaagcggctgatgatccggtcatcgggtccattttaggcgggatgaacccgcatcatgccattgtctcaggactcggcgcaatgccggagagcagcacgggcgttccgtggagcgcaggctatatcgtcgcaagcggaaaccttctggcagacttccgcgccaatctgaacgccgaatcacaaggaaggcttcaagtcgcacgcctgtatgaaatgaccgatgataaaggcgtgaaagatatgctcagctttttattggcccgcgataccatgcatcaaaaccaatggcttgcggccattaaagaattagaagaacaggaaggtccgatcgttccttccacattcccgaaggcgctggaaaaacagtcattctcccataagcttattcatttctcagatggagcagaaagcgctgaacaaaattggctgaaggaaacagcgccggacggagaaccatttgaatacgaaaaggaaccgaaagcgcacggcgaaatagctaagctggaccccgtcccgccgtatgtccacaacacgcttcccggacgaaaataaaaaagcctctaaaggggctttttttatgtgcgcacaactgtccagtccggttcgtaccggatgtcggggtgatgtaacagctcgtgaatgacaggttcatccccctcgtacagcatcacttctattgaaagaatcgcagccttctgctcgttttcttcgtatatgcggtcatgttcgttctccataaaatcatcataggcctgtctgtcctcccaaacgctgatgatctctgcgatgaacaggccgtctgcgtttttccgccagccgcctgcctgtctgacgaagccatttacacatgataatgctccccaccttgactgtgcttgcgcaaatgcttcagcgtttgcagcgtctgtttcacatacaatctttttgatcagcatgaccgttcctctgtgatgactgttttcgcatgcgtatgctcgacacagagattcacggttctgacgtaagagcgggtgcggtgaatcgtgcctttcgggatgagcaggctgtcatttgctttgagcactgcggtttctttgtccttaaaatcgatcagcagctcaccttccagaacgatgaaccattcatctgagtcagggtgatggtgccagtcatattctcccgtaaacactgcgaggcgcacacagtggtcattgatctccgcgattgaaaaattgtcgtgtttttctttgactttatggcgatagcgagcaaattcagcatgtcagacacgagtgaaaaacccctttttcattttattgtatcggttttgcggctcagatcaagattttcccaaaatcaaaagcgatccggctgatgtgccggatcgcttttgatctgcaggttgtctgccttttatgcttttattagctgcttcgtctgtttccgcctttttggccgatttctttataaaactctttgtcatgatttttacttgtagcttctccgcctttttggccgatttcctgatagaattccttgtcatggttattgcttgtggcttctccgcctttttcaccgatttcctgatagaattctttgtcgtgatttttgcttgtggcttctccgcctttttcaccgatttcctgatagaattctttgtcgtgatttttgcttgtggcttctccgcctttttgaccaatttcctgatagaattctttgtcatggttattgcttgtagcttctccgccttttttacctgcttcttctctgctcattttgttattatcttgtgccatttttgaattcctcctttaattggtgttggttgttggtttcccgatttcagaactgataaacaaagaaaacacattgaatgtgttttcgggtggttttttatcattctgtatcgttcatgcgttttagaatccggcgttttttataaagcatgatgcctgtttccgcgatgctttctaaagctgaacggttggcggacgcgccgaagatgatgcctgcggccggaaccatttgcagcagttttttcgcggcgaacgtatcgcggtagctgtaaacgacttcccgccagccttggatttgcgaggcgacgcgctgataggtttggtcgttttgatcatattgccgtaaatcttgcaggatcgctttttttccgatgacgtcactggatgcaagctgaagcaatttgacgataaacacgcgttcttttttgtctttcggatcaaagccgtaagcaaccgcgatatcttgcagcgtctttaaggacaggccgagcatcgccggaatgtctgccgcaagcgtaaacacgccgccgactcccgttgcggctccctgcaccgtcgcggcctttacgcttgtacgcgctatggcttctgcgatttcgtccatgacggcaagcggcgcattgcggatgtcgtgaagcgtttgacatgtaccgtgcggcagccgtttttgaaactttttcatgatgcgcttttctgatgtaaggtactgtccgcctgactgaataaacgttcccgtttcatcgagaatgagtccgattttcctctgaataaattgcggtgtcagcttgtccaaaagctgaaacggcaagcgggtgaatgtttgccagaacatcgccctctgctgcgccttttcccatttttgaatgtctctcagttgtctttccaggtctgtccgctcttctgtcacccgtcctgcacgtcctttctgatttctttctacatagtatacctttatggcgttttctttttacacccggccggactttttatccggaaaacattccattgattaattttcttcaaattctatatattttataattttgaataatacgattgaaggagaatgctgtatgcaatggatttatttaagtttagcgatcatttttgaagtattgggtacgatcagcatgaaattatcaaatggatttacaaaacttgttccaagtattttattgttattgttttatatcggcagcctttgttttcttactttgactttgaaatatataagtgtctccatcgcgtatgcggtctggtcgggaatggggatcgtactgatttccgcgatcggaatttttttctttcatgaacagttctctgttataaaagctgtctctgttcttctgatcatcatcggtgtcgtttccttaaactttatttccgaaagtgaaacgtcatcaaacggcatcagcgttcatacggacagaaacaggtgatgaaagggttaaaggttctcttcctcattacagatattggatttatcatttattggattgttactttttttgagtagattccaaaaaacatggcgtttaaagattatgataacgccatgataatggcctggaactggtcattctttcccctagatattttcatttcattgaccgggctgtacagcttgtttctttataaacggaaacattcgttatggcgccatttcgcattaatatcacttgtgctgaccttttgttcaggcctgcaagcgattgccttttgggtatttatcggtgattttgatctcatgtggtgggcattcaatctgtacttgcttctttatcctttatattttattcggaaattgctggtctctcgtaaaaatagctgtcattctttttgatgaggcggttttctttttcttcaggcgggaaacacttttcataaaggagtgatagacatgccttggtctatgaaggattatccgcaatcattgaagaatctcgaggaacctgtgaagaaaaaagcgatcgaaatcgcgaatgcgatggtagatgagggttatgaagaaggacgggctattcccattgcgacaagtcaggcgaaagagtggaaaaaaaacgcttctaaagaagaaatcgatcagctgatgaaacacgatgatgaaacgaaacgcggaaattgaatcggaatatagaaaaaccccgctctcaagagaacgaggtttttctgcttataaaccgtaataataagatagtgtggtgactgaaacgtagcctgtcgctcctgcatacgtgactttcagccatttattggaattggtgtagtggccttgaacatattctccggtgacccaagaacctgtaatttttttaccgcttgagaatgttgtgatcgttgaacagctgaccttagagcatgagcgcatattagcaccgtaaataccgactgtgcccccgctggctaaaatggaaacgtccggttcagctttaggtttgaaagctgctgctgatgcagagccgccaaaagcgaataaagaaacagcaaaaatcatggctaaagaaatgatcgacaaacgacgtaccaagaaaattccccctcttttatcatatggccggaaagctttcctgacgttattatacttttttgcccggaagactgaaataagtctaatgctccaacttcttttcttcgcaagtgaccatgccgattctttttttgatagataacagccgtttattggactggaatcactgatatatcgttgattcaaacgtttattcagagcggccggagtttttccggaggtcatttgaatggtacagaaaggttttatcttccaatggaaagaaacattattattctatttacccgggaaacggaggaaatactgcgtctttttctcaggatcagttgcaccggacagaaagttgtgaagtgatatgagcaagtgttctcttttcacctttttaaaagaacgctcaacgcatccgcgcatgatcggacgcggaaacatgctttgcgaacggcatcgcttctttcccggaacgatgccgttttcattttcggacctttcttcggcgggatacatatcatagataaaacagggcatcaatgtaccggtttattgaacataaagaacttgacatctcataaaagcggatttatgatgtagataaaataatttgcatctaggaaactttttgttatttagctaaaaatctatcggaatttaggtgagacataatgagcaaagacatctcagcacaatcactgcaagcaaaagccgtgcaggatgcacttgacggcaaaagcaagggattcaagcggcttctgcctttcttaggcccagcctttatcgcggcgattgcctacattgatccgggaaacttcgctacgaatatctcagctggttcgaaatttgggtatatgctgctgtgggtcatcctcttttcaaacttgatggcttttttaatccaagttctttccgcgaagctcggcattgccacgggtaaaaaccttccggaaatcgccagagaccggtatccgaaatgggtatccgccgggctgtggatacagggtgaactggtgattatggcaactgacctggcagaatttatcggggcggcgctcgggctcaacctgctgttcggcataccgatggttgaagcggccattatcgcggcgatcggatcattcgcgattttagagctgcagcgccggggttaccgggcgctggaagcgggcatcgccggacttctgtttgtcgtggtgatcgccttcgctctgcagaccttctttgccaaacctgacgccggctctgttctcgaagggctgtttatcccgaaaattgacggaatggacagtgtgctcttggcaaccgggatactcggcgcaaccgtgatgccgcatgccatttacttacattccgcactgacacagcgccgtgtcgtcggaaaaacggataatgagcggaaaaagatttttagattcgagacgattgacattctcatcgcgatggtgatcgccggggcgattaacgcaagcatgctcatcgtcgccgccgcgcttttcttcaagaacgggctgtatgtagaagatttagacgtggcttatcagcaattcggccactatatcggaccggcttcagccattctcttcgggatcgggctgctggccgcagggctttcaagctcttctgtcggcacattgtcaggcgatattatcatgcagggcttcatccgttaccgtatcccgctttatttgcggcgtttcattaccatcattccgccgatgatcatcattatctcgggggtcaacgccacagaagcgctcgtatggagccaggtcgttctttcattcggcatctcctttgcgctcgtgccgctgattatgtttacaagcaacaaacgcctgatgggcgccctgacgaaccgaaaatgggtgacggctctcgcctggctgattgcggttttggtgatcgcgcttaatctgtttgtgatctacgattcattccgttagaaaaaaaccggccgtagcggccggtttttcttttgacgccggatgccgttcgtatctttttccgggcgtttttggtatgatagaagaaaaatcggagttttgcttatgtcagtatttatccttttttatctgtggattgtgccgattgtcatcggtatcttctgttctctttttgcttatcggacaacgggtaagaaacgtctgattcccggctttgtgatgatcgcattaagtatcgtttccttaatcacggggctttggatcggcggggtgaactatcatgtgttcatcggaggcatgtttttattcggtacgtttttggccggttccgccttcccgtttttcttcgctctctcacgcaaacgaaaataaacaggcatgccgcctgtttattttttttacctaagcctgcattataaaaaccgctccgataatgtgattccgcctcaatcagcctatacatgcaggctccagcccatgttcatttcacgaaactgcagctaaaataaatcctgccaaaaaaaaattttgaattgcgagaaaaatatcgtattaaaatcctatttacccaaaaaatacctattgatagaatggtatctgagagggaaaaatgttcaaagcggatcatacaggtcccgcctaaatacatagtctttcatttctctctacactacatttctaaaggaggatttcccattagacacgcagctaaaggcattctgtttgccgcatctttagcccttgtaactactgcttttgtccccgcatccttagctaaagaaaatcatcataatactgccaatgccactggaacgacaaaatcatttttttatcagactgatacgcaattttcctacggacttaaagcacaaagcgatgcatctgtgtcaaaaccagtcaaagatgtaatcagagaagtgctgaaaaataaaacaaaattattcaatcttgttgaaaaattagcaggaaagaaaataagaaatgaactcgaatccgttttcaatgaacacatcgaaccggttttaaagaaaatgctgaacgagtatgtcgccttaagctggactgacgtggaaaagaatctttatctttcacttaaaaagtccggactttctgacagccaggctaaaaacctcgctcatttgacaactttagcaatgaaagcattttaaaatcattcataaatgatcgtcaggaaaatacgtataaagtaatgcaaagtgctgttagattcactctaatagcactttttcattggagatgtcacatgactgtcttttttactgttttgctcactttcttatgctgccttgtgatttcatctcttatttttatgattctattaaaaaaagagatcgtggatacaccgccaaaccgcttagctcatgcagcattcatcatacttattggattctccctgttcttcgctgtgactgtccccagcctgattatttgttttgcagctgtaacaatacatcattttttcggagagtatatcatctatggttcactttcagacttatacatattttctgtcgtcgtcagtatcttagctttagtttatatgctaatccttacggcaattgtaaaaggaatgactcatgtttttacattacctgcttggtcagcctatatccttgaattcatttttgcatgggctgctgtttacttctcaatccaatacgtttccaatcatatcattgagaacatatctatatttcaaggtggagaaattcttctttcattgttcatcactttcttattttcgggattggatatcctttttactaatttggataagatcacaaaagagaaattaggctaagggggtaacaaatatgaggatcatgacatatatatcttatttttctatttctttagttttgcaggtggtatggctgctattaataaaagatactcctaatatatttctgatagatatgattacggtgtccttcttattcactctctttatgttcatcttggatcaaatgttcaaaaaaaagcggacaaattagggtctgtttttaataatcctcgggcttctctttcgttttgaaattgttccggatctggggatgttgcggcgaaccgttcattaatgtttaacaccagcctcggtaaaatacttctccttttatataacatcctgacttttccgtcatatattcaaacgaaaaaacggcaaaaaggagtaatgaaacatgatattgtttattggcaagttcatgttgctctttttattctgttcgctggcatattatttgtttaaagttgtttattacaatatagggaagaacattgcgcttaaaactccgaaagggacaaagacgaaccggacggcacatgtgtttgtcaaaaatggaactaaactgaatgatggagattactttatgatcgctgttgtgaccgctctctggctgttcttcagatgaaaccgcgctgatccatcacgagttttttgatcagccatcgctcgccagctgccgattttcacaatcatcgttttcgtttaggacgactatatgcaagcaagccgctcaacaaacaaaggagctgtcgagatcttctcgatagctcttttgtttgtccttgaatgattgaagataggcttaaaaatggacggcgtctttctcatgcatgcatcgttcaagaaaacacttcacagcaaaacggaaaggtgaacgcaatacaagtaacggttaagaaccttatgaggcagcgtatgttgattactggataagaaaaagaaatcccccagtcttaaaaggtggaggtcaaaaattggagaacacttaaatatttatagctttttcagcgatataaaaagttccagagtcactcatttcagcagtataaacatttgtcacacttaataatccagtaaaaagaataccgattaaagcggagctgattataagtttcttcattatatagcctccgtaaccttaagtatttgtgtttgggcatgtatggttttctttaaaaagtttcttccctctgcatagtttctcttctcaaaatgaaagtcacctaatttttcggttagctctgcgaaatcagaccaaaggcgtttctcttccaagtaacctaagctttgtttcacttctgtttcattatattcttcgtacaatgaattaatgatttttaatttagccaaatattcctcttcattagaagtccgagcacgatttaaagccgtttcataaaagaaacgtgcttccttggctttatcacattggtacaggacattcgccatcatatataatgatctcactccatacactgtatcaatatgttctttcacgtctattgcctttttgaaattctcttcagcagcaatcaaatttttccctcttaaataaactaagcctgagttatgaaagatcactccgataattcttttcactttttcctcatccaagccacgggcgttacttaatgcttcccgataatatgattctgcctccgtcagcctgtacatatcgtacatgttagcaccgaccatcatattacagccaatcactttcactttgtataattgatttttttcaaacaattgcttggctttttttaaatgattgagggaaacaaagtgctgatcaatttgataataggcatcagctattttgtaatgaaattcagcttgctccatttcatctgatacagcattcaactctctctctgctttgcgataatagcttatcgcatcaacatactctttatgatcaaattcatacattccacgaaaaaataatgagtaatacttcaagaggcctgtaagtcttttttgcggcttttctattttttcaagtagttcgtcgactgtggggcgatctcgatatctgtcttccggctccaaggaatctaacatcaattggtgacgaaagcacatcaatgaataaaaaacaagcaaatcctgatcctcttccatctcctctatttcctgttcgacctcagcctttaaaatctcagcatcaggcacactgaactggcgaatcattttgtaccattcattgatcttgacaccaacttgggacgacggtaaaacttgatccatatatacctctccctctaattgctatttttgtaatattataactatttgaacataaagtgaaaacgaaaaaaaaccgcaatttacttttgcgtcatactcacctgattaacttgttttaagacacagggaaattatacctcaacataaaaatactgtataaaaatactatttacccaaaaaatacctattgatagaatggtttctgaaggaggtggaaaaatattcaaagagaataatataggactatcctaaatacatagtctttcatttcgctggcagattacattcctaaaggaggatttttcattaaacacgtagctaacggtattctattcgccacatctttagcccttgtaactgcttcttttgtccccacatcctgagctgaagaaaaccgagataccactactaatgccactggaattaccaaaccaattttttataataattgataagccgttttccttttagcttaaactggttttaaagaagctattaaacgaatatgttgccttgagttgtattgacgtggagagaatctttatctttcacttaaaaagtctggactttctgacaaggctaaaagcctcgctcattggacaacgttagcgatgaaacattttattgttattcataaattattaggaggaaaatatatatgaagaagaaagtaatccctgtagttttaagcgcaactctacttacatcattcttgggtacttcaggtgctttagcagctgaaaacagaaccacaactcctgtaccggtaacgaaaactgcaccaggtactattccaactggaatgcctggcactattccaaccaaagcggctctcaatggtgactaccaaacccaaggtgtagtttcgtggtcctataaggctttcagagctgcctgccgttcaggtggatggcttttatcaaaagccttaaagccattctcccctaaagctgcggcatggattagaaaaaactctaagaaggttgccgacattatggataaaggtgaaaattggggtgtaaaacaatttacaaaagcttttaaagctatcggagctcctacagatgtagctaccactttagctaaattcattgttgctttgatttaacatatttaaaatttaaagtgctgttagattcactctaatagcactttttcattggaggttaacatggctatctttattaccgtattgctcaccatactatgctgtcttgttatttcatctcttatttttatgattctattaaaaaaggagattgtggatacaccacccaaccacttagctcatatagcattcatagggcttattggattctccctgttcttcgctataactgtacctagcctaggtatttattttgtagctataactgtaaatcattttttcggagagtatatcatctatggttcactttcagacttatacatattttctgttgtcgtaagtattttagctttaatttatatgctaatccttatggcaattgtaaaaggaattactcatatttttaaattacctgcttggttagcctatatacttgaattcatttttgcatgggctgctgtttacttctcaattaaatatgtttccagtaatttcattgaaaacatatctatatttcaaggtggagaaattcttctttcattcttcataactttcttattttcgggcctggatatactttttactaatttggataagatctcaaaagagaaattaggctaataaaaagaaaagcaggcaatttagagcctgcttttttattccctttttaacatttctccaagccttgctttcgttttcggcccgtaaatgccgtcagcaggcagtccatacatggactggaaccgtttgactgcatttgctgtcttcggtccgtaatagccatctattccgttgttctttgcccctttgtccggataataatagagagccgccaaagctgtctggatctgtttcacggccgttcccttagttaaggggcttgtcactttaaaaacgcccgatggcagcgtgtaagatgattttttgccttttgttggagagctggccgagtccgtcagctttaatacttggccgactttgataaaattcgggcccttgatactgttcaatctctggatggtggccatgtttacggcagttttctgtgcaattacagggaggacatctcccttcttgacggtgtacgtcgccacgccagtctttgttcctgtttttgctgataagggctgtgcgatgctaatgagcgaaccacgtttgttatgaactgtcctggccctccaaaagcttttttatcagccatcgcttgctagctgcagattttacgattttctttaccgtttccgcagattttaatacgatatactttcggttacggttcccgtcctctaagcttccaagcgggtcaaactgctgaccacttccttaccatggaagggggtcagtaaagaaataatcatcaataagaaagcctaaaaaaattaacaggcatgctgcctgttaatttttttataaccaccggcttcttaaaacagccgttttaagcttttcttgagtgacggcatttcgattttttggttttcaaagaagtttttcagcatgtatttgctgaagcccttcgcttggccgtaagtgatttttcccggaagcggcggctcgtcgccgatgacggcgtcgatgacgaccggctcatttgagttgagcgcttcatgaaaagcgggagccaattcctcgtgtttcgtcactttgatgccttttgccccgcagctttctgcaaaggcggcgtaatccatattttgcagctgggtgacgtagtcaatgttgcctttgacccgctgttcatattcaatcatgcctaaattttcgttgtttaatatgacaaccgtaatcggcagtttatatttaacagccgtcggcagatcctgcatcaccattgaaaatccgccgtctccgcaaatggcgatggactgccgatcaggttcggcaaggcttgcggcaatcgctcccggaagcccgcatcccattgtggcgagccagcttgagacgataaagtcctgcttcttcattttaaaatggcgggccatccacactgtaaccgttccgacatccactgacaggacggcgtcctctgcggccgcatcctgaagccgggcaatgacctgctgcggcttgagcggatgagtcgcttcggtttcatccttttcgatttccttccaccaatgcttcatgtgctcggtgcaggcgtccaaaaatcttctgtcttctttatattcaatgtattccgtcagctctttcagccccagagccgcatcactgacgattcccgcattgacgggatagcgcttgccgattttcgccggatccgaatcaagctgaatggcgggcgtatcatccgggagataatccctgtacgggaacgatgtgccgagcatgatcagcagatcgcattcctccatggcttcgtaggcgggctttgtgccgatttgcccgagattcccgagaaagtggggatggctgtcaggcacgacgccttttgccggaagagtaatcacaatcggagcggccgctttatcggcgaatgcgagcagctcctcttttgccgattttaacccttggccggcaagaatgaccggtttttttgcgttgttaatatattgcgcgcatgtgacgagatgttcttttttcggctctatatcggctttgaggtatatcggcgatgtgtaaaccggctcccgtttgattttttgcgcgaataaatcatcagaaacggttaaaacggcaacgccttttttgctgtaagccgtgcggatcgcctgattcagaagatcgggcagcgcttctgccgtatgtacctgctggttgaataccgccacgtcctcaaacatctgctctaatttgatttcctgaaagctgtcacggccgatttcatcggaagccacctgtcccgcaatcgccagcaccggaacgccgtccgctttggcgtcgtataaaccgttcagcagatgaacggcccccggtcctgcgattgaaaggcagacaccgatctgcccggtcagttttgcctcagccgcggcagccagggctgcgacttcttcgtgccgggtttggatgaatgtcaggttatttcgttcatgtctcagttcttcgataaattcattaatgctgtctccgggaatgccgtatatatgaccgactccccattgttcaagcagctccgtcattacgtgtcctgctgttttacttggcatactgcatcctccttttacctgtattcatccctttttcatacgggttgaaacacgggctatactctcagcttttttctcagcagatcaaggatggataacagatttcggtctttaaggactgccttacgatttgccgccccattgagtccgtcttttatttgccgttttctgttcggcaccatgaacagcggcagccggttttgggaaaaccagcgtaaatcggcggtttccgatccgttcatcagcggtgttcctccggtaatggctccgatgaaaacgtgctgtgtatcttcaaatgccggcctttcatactcaccggatttttgcaggatggtcacgttataccctgtttcttcaaaggcctctctgacggctgcggcttcagatgtttcaccttcttcaatcccgcccccgggcaaatcccatagtggaacgtcttttcgttttacgagcaatatgtcccgcccatcattttgtatgatgacaaaagcgccttgtgccatgtcgtcctcctttacaaaaaagaccgcggcatttcagcctgcggtctttccgttactttttaaaatgatacggcagggtggcgacgatgatgtccttcttccaaaacagccggacgcggagcaagaaggctgattggttgtgaaggatggtctgccagcgttttttcgtaataaattgcggaaacagcaccatcacggagaactgttcttttttcgctttttgttcgaccgtttccaaaaacttatcaaacgggtgaaccagactgcggtatgaggaatgcagggtgacgaggcggacgccgttatgaagctcttcccagcgcttttccacctttttttcgtgttctctgtcaaaggaaacatgaaccgcaatgacctgatccgataatgatttcgcatactgaatcgatttttggacgacggtggtgacaccggcgacaggcacgatgacgacggttcccttgatttcctcaggctgctgatcaacgacccgcagctgttcgccgaccgcggtgtagtgatttttaatgacgaaaaacagcatgacgacagcaggcatgaataacagcaccggccagacaagattgaacttcgtcgcgaataaaatacacagcaccataaatgaaatggcggcgccgcatgagttgatcagcatttttaccgcccagcccttcggcttctgcctgatccacttgatgcacattcccgtctgcgacagcgtaaacggaatgaacacgccgacggcataaagcggaattaaatgttccgtgcggccgccgaataaaagaatgagcaggatggacgcgataccgagaaagatgattccgtttgaaaatcctaatcggtcgcctcgtaccgtaaacattctcggcatatactgatcgcgcgctaaattaaacgccagctgcggaaaagcggaaaagcccgtatttgccgcaagcacaagaatcagggatgtcacgccttgaatgaaatagtacaccgtatggcgtccgaaggtttccgcggcgatttgtgaaataacggtctcgttaggcttcggacccgtgccgtagccgtacgccagcaccgtaatccccgtaaataagatcgccagcagaatccccatcatggccaaagtgcgggccgcgtttttcgccggaggatttttaaaggccgggatcgcgtttgaaatggcttccacaccggtcagtgccgagcagccggatgaaaaggccttcagcagcaaaaacagcgtgatgcccgctacgggcgtgccgatcggtgtatgctcggccggatgaacctggcccgtcatgagcttaaacagaccgacgacgatcaaaaggacaagcgccgccacaaacagatagacgggatacgccaaaatggacgccgattctgacagccctctcaaatttaaaatcataatcagaatcacaagcaaaacagcaatgagcaaatgatacgggtgcagggccggaaatgccgatgtaatcgcgtcagttccggcagaaatgcttaccgccaccgtcagaatataatcaacaagcaatgagccgcccgcaatcaggccgggcttctcaccaagattttctttagaaaccatataagcgcctccgccttgcggataagcgtaaataatctgtctgtaggacagaatcaaagcaagcagcaaaatgagaacacccgctgcgatcggaatggaataccaaaacgcggccgcgcttaccgcagccaaaatgatcagaatctgttccgttccgtaagcaactgatgacagcgcgtctgaagaaagcatggcgagcgccttgagtttcgtgagtttctgctctccggccgcctgtgatttcagcggtttcccaatcaaaaatcttttgattgaatggtacattttttgtcttcccctttttttcattttccgtttgatttacaaacccttactgctatgatgtctctgaataacgattgcatgccatatttcggcacagcaaaaagacacagaggcaaacggatgcccctgcgccataatcgtgcacaggtttcattcatctcctctcatgaacgcttacgaggttagctgtcggattcgggctgatgagagttggccctacctgaaaaaggattcaccccaagcggcatgacgcgccgcaaattggttcccccgctctgattacagattaagcgatatagattataaaagagatcatactcccgtcccgttcagttgtaaaggggcttttatgctgtttcaaaaataaaaaatcaccgccaaaaatggaaataaaaatacaaaaaagaggcctgttaacggcctctttttccttcattactcttcacttttttcattatccgcttttcttttttccttcttgccgtcagccagatcagaccggccgcaataattataagcgccgcgaaaacagcgatatacgtgacgttcagtgctgcggaacggcttttcgtatcaggcgccggactgctgtcgtcggatttgatttgctgatggtttgaaaacagctgcttgccggccgtttcgttgacgacggttgcggcatcgcttgtgctgtctaaaaagctgatcagctcttttgtgacagacgcgccgctgcctgataacggagcaaaaacagcgatgcttcggccggagtcccaaggtgattcctgggtaaacgcgacttgtttcgttgtctcattcagcatctgaaacgaagaaacatcgtacgcgccgctgcggtctgacggcacgagaagcttagaggcgtttgatttcaaaagcggaatttgcggcaggcctccgataaacacaacattccggcctttggcatccgcttccttcatgtctgatgccgtctttacggtaaagccgtttccgaatgaatccgccaccagagaaagttctttcagtgtctgtatgtttacgtcatccgggatgacgatcactgttttctctttcacgccgcccgcaaacgggagcggccattgcccgaaatccgctttctgcgccgcatcacttaccggatacgtcagcatgctgcttttatcaatatagacccatttattttcgtcacggtcaatacacgggttgttatgtttcaaacctgatgtgacaaattgcagatcaatgtacctgctgcttcgcaaaagcttcggatcaatcgggattgagacgtggtaaaagccatctttatcttgattgccgagatcatcaaggcgcaccgcattcggctgtccgttgatcatgacgttcagctccgctctctcggcgtcattagctgaatccgccttcgtccggatcgattccgacgtctttaatgtaagtgaaagcttgaccttaccgtctttatcaacagcggccgccgcagggtaaaagaagtgctctgacgccgttttgtttgatccgaccgttacatttcccgcgccgaagtcctctaatgtcagtttattgcctgtcttttccgcagcgggctgaaggcggccgattgtcaaagtatctccgcccagctggcttgaataagcgctgtctgtgatgacgcggattttatccgccagcgttttgtctgagtgcgccgtgacaaacaggacgggctgccgtttgtcccctgatgtcagaacccgttcggcgagaaggagtttgttgtcttccgctttgaagttcccccgttcgaaaagctcttttattttcccgttccaatgctgatcagcgccgatgacaattgacggattgctgattttgccggcatcggattcttttacataggataccttcagcctgctgtctgccgttttcagaaatccttctgttttgactgcggcttcagcttccgccgaggtcggtttgtcaggaaggataatatcggtttcttcacccgtattgcctgattgggcaaacggatacgggaaatggccgagatccgctccctttgacttgcttgcttctgaaagcacaaggcggctgtccggataaatttttatccagttgcctgacgtatcctgcctgacgcagacgccctcttttaatacgccgtaaaatcgtaatgatacattgtgatagccttgggcggattggcttttgctgagattgagcttcaccgttttccgcttggagctgccgtcaagctttatggatttgacgggttcatcatcaatggcgatggttaaagaagacggggcaattaataagtttgacgcctcgtaatcaatcagaagcgactgatcggcattcgaagctcccgcaggaatctgataggtcagctctgagctgtctttcgccccgtacagtgtcatcagatcgccagtcagcgcctgctgctcttttgcgccggcgcttgttccgagagcggaaccgtccgttttcagctcccgggccgcggccgcctgcccgttatacatcaatagcaaaaggccagttatcaatatcgcttttttcaaaaaggtcacccgcttttattttgattgtatcgctccgttttgtaccacttgacttcctgcttgaacaatcggtgcttgatctctgtgaataatgaccagatgacgagcacgatccaagcctgagagtatgtaaagtacatcagaaatacgataaagaagttttgtttgttcatttctgttttttcaatgcttaaagtaatcatgacctcagtcataaacaggaaaaaggccagtatccacaaaatcatcgccaaaaacccgactgtcagatgcaggtcgtaaaaaagattgatgataaaaatcgtgtttgacatgatcacaccgaagaaaaacaaaaaatacgtaaaaaagaaataaaacagatcgaagatgatccgcttgcgtttcagcttgaaaaattgggataaaaacttaagaacgacgtactggttgccgcgcgcccatcttgtccgctgacgccaccagaccttccatgtctcaggctcctgctcccatgtcacagccgccgggaaaaagcggatatgatagccgagattatacacgcggatggtcagctcggtatcctccgccagcgccttatcatcccagccgccgagctgttcgataatgctccgcctgatcgcgaagttcgttcccgggatggtggcgattttgaaccatttccatctgccgccctgcgccatccactgaaaacagatggtttcaatattgataaacttcgtcaggatcgttttcgccgcattgataacacggaatttcccgacaaccgctcccgctttctcatcattcatcagaccgagaaccaggtagtacaccgccattttttccggcgtattgtccgcatcatacacgcagatcacgtctccgttcgattccgcgaaccctgagttcagcgccgaagattttccttttccggcgttcggggctttgtgatgaccattttaatgaagtcatactgacgggaaaattcattgacgatgtctcccgtccggtcggaggaattatcattaacgacaatgatctcaagcctgtctttcggataatacaggttcaccatcgccttcagcgtctgcctgatgacgacctcctcgttatgcgcggggatgagcacgctgaccttcgggagctcccccatctttgcgcgccatttcggaatgttccgttcgaaggtcatataatgcctgaatccgccctgcatcagaaacatgtgatagagaagcatcacccatattaaacttaatgagataaaaaacagaatgttactcaaggcttcttctctccttaaagattcgtttttttaatgtggcgcgcaaataaaggacgtagcaggcgaacatgatgataaacaataacaccacgccggagagaatccaaagcgctttttcaagaggcgtctgctggtgatgattgaaaaaggccgttaccggatgaatcttgttttccacatgaatggttccgtctccgtccgttttgatcctgacgctgtccgacgttaccgtttgcttcgttttcttcagatcgagccactcgccgccgggaatccgctccatctgattgacgagctcgggaaggtatttcatgccgagatacggatggtagaaaccgcccgccgttccgccgccgaaatcaatcatctgagaaatatgattctccatatctccgagcggattttcctttgagttatcggcataaccgattgtttcagggtacagcgtcatcccgtccagcatagccggctttgagacgaacggaggggcgcccgaggttttccacgtcgcgccgctgagctgcacttgtccgaaaatgctggagaaataagaagatgcgattttgtagccttcttcagacatcgtgtagtgcggcgcttcgaatgacagcgggtaaaggccgagctctgtcagatcgtcaatcgcctgctccagcttcgttctcgtgtagatgttttctttttcacggaaaggcttcacatacgcccggtacgctttttcattcggaaaatcctgttccttttcaagcttgaccggagtatcatccgcattttctgacgtaatcggctgatccgctttggcatcccaaaattcaaagccttctcccgtttcgctgtatcggtatgcgtgcgtgtagccgtgaataatgatgctaccgcccatttgctgaagttttttcaggacgctgaccatttttggcttgtccgccaggtatactttttctccgttttccggattgagatagaccggaatgaccgccagaataaacggaatgtgtcttttatgcaggtaagcgcccgcttcgtaaagcaatctttcatctgacatcggactgatgtcttcaagccgcaaataaaggagggtgccgccctctgattctccgaatgcgctgcgcatcgctttcgccgtcagaaacgaatcatttaacaggctcgtcacaccgaaataatagtcagagcgcgccgttttccacataaaagggcgggtgctgccgtcaccggaccggtatgtataaagggactttccttttactcccgatacgccgagcacggacacccccttttcaagcggcatgtctgttttttcttttttgccgtaaatgcggtataccgtttctttttctgtcagggacaaccccgcaaattggcggaactgtccggcgttatagccgatgctgataagctgctgcggcatgctgctgatcagtgacacaaatgatgtgctgagcttttttttcgtgacgccgtaatagatgacgcgccgattctttttgaagtccgcggctgtgatgtctccgtcgcttttcacggtgacggcggatgagaaatggcccgcggtcagatcaagcattttgacctcagcggtttctttgccgtccgtgcttgtataaataatgagaatgccgtcctttttgtcttttgcttccgccggacggggaacataaaccgccgaaatcatgaaaagcgccgagagtaagagacgtatccatttagagttcattcatcatcatctcgttttccagttcatttaaaaattgctcggccgtttgtaaatcctttcggtacgccaagtaacatacacggaaggtgatggagacgtatttaccgttttgcagccggtacgtatccaattcctttttcagcttcgccagaacggccggcatgttttcttcaggcgtatgggtcagcacgatgccgaaccgttcggcggacggcctgaattttttgtctgtttcccgaacgcttgaccggatttggcggctgataaacgccagcagccgatcggtctctttttctccgtatagggatttgaattccttgaaataatgcatgtgcagcagcaaaaagacgaaggaattgccgtagcgttccgcccgcttgatttcctcggaaagctccagcttcatccgcagatggttgtcaaagccggtcaccctgtcgacggcgacaaagctcgtaatctcttcacgcagctgtttcactgagcgttcaagccccttcgccaactcgtgaatccttcccgctatgtaagaaaagagcagcagcgcaatcccccaaatgaccagcacctgcagactttcggcatcggcagacgccataaagctcccggtctgaaaccacaggagcaggctgccgagaacaaataagacgagtaaggtcatgacgagcgcgtagattgccccgaaccatataccggctcccgcaacaagcaatgtgatgcaggttatcagaagccctgcggattgctgagacgcatagtaaataaaaaaagacagcagcaccagcataactgctgtgtagctgcacagtttttgtgattcattgaatgatattttcattaaacaatttcctttcagccagaagcggcagcaggttatcgaaagaatgtgtatcgctcccgctcatatagccgccgtaatcgggtttcagcgtgtccagtgtttcaaatgaagtcattctttcataaagcggcttgatgacagccggatcagctttttgttctgctaaaaaaagaacggccagggcgtaaacggacggtgattcgtactgaaccgccggctccttcgtgtctgcgctgtatcgtccgtacagctgtccgcgcgacttaaattcctctatcatccattttgacagcgcggcagccttgccatcgccccgcttcagattcacggcggcgtacagctggtcgatgacattcacttcgctgtcatatttgtattcctttgtttcggtattgaatgatttcggcagaaaaccatttttcaggggagctcgattgagaacatcaaggttccggttttccgttttctcatcgataatccctttttctctgagcatctgtaaggcgccggggtcaacataggacaaggtcacggtctttgatgcggcatttgaagcggcatcataataatccgtaaaatacccgtcatttgtattgtatttttccagcgccttcccgatctgcaccgctgttttcccgtattcactgtttccccacagggttccggcctcattcagacagttcatgattctgaaatcgtcaattaaggcattggtgccgctcgctttattcccgtcaatcttccacgacacgagcccgtttttcgtcagaaacgaatcggtgagaagctgatattgcgcttgaaactgccgttcatctttcctgttcagcaaaaatgccatccatagtccgagagactcagataaatattccggctcaccggatatgttcgtccggatcatcccccgcccgttcatcaatttatgataaataaaatgctctgcgggctgaagcggtccggacggttcggccgccgtctgtttttcaggtccggcctccgcgcaccccgccgtcagaacgattgaaatcaaaaggatcatcagacgaaaaacgaattgcttcacagtccatcctcctattttacaaatccttttttagacccatatcttattttttcacaaagtatttttactataaaggaaacgataaaagaatactagcattttttcacattggaaaattttaaatggaagcgccgcctctcaccttttccctcttcacatggatcgtattcccattacagtaaaaaacacaacaaaaggcagcatttctttacaaatgctgcctttctctgatctatttatccaggccgagttttttcagctgttctgccagcgcgttgttcatcggctcctctttgttttggcttttcatataagagttaatgtcccgcttggatgcgcgtccggatttatctttcgccttccgcttttcaaagacggacagtttctcccggtggccgcatacacatgcgaaggtttggccttcgccctggccgcgaagctccattttcttatgacagttcggacagcgggcgtttgtttttcttgccagcgttttccggctgccgcactcacgatcctgacatacgagcatcgtgccgcgtttgccgttgactttaagcatcattttgccgcaatcagggcaggcggtgcctgaaatgttgtcatgtctgaaagtctggctgctgtttttgatctccttcaccgttttgcccgcatatgttttcatgtctttaatgaacacggcggatttcagtttgcccgctgcgatggcggagagcttttgctcccattcagcggttaaggccggcgatttcaaatcttccgggacgagctgtaagagctgcttcccttttgacgtaatgaaaatatctttttcttttttctcgatcaagaaactgttgaacagtttttcaatgatatcagcgcgggtggcgactgttccgagtccgccggtttcacccaatgttttcacaaggttcttctcttctccctgcataaaggcgcttgggttctccatcgcggataacagcgtgccttcattaaagcgcgccggcggtttcgtctgaccgctcgtttctttcaatgatgagacagtgaggcgctgcccctgctgaagatccgggagcgtctggtctttgtcttcctcatgatcgtcgtcatcctcgtacatatcatacacggctttccagccaggcgattgaaccgttttcccttttgcggtaaatgtttcgccgccgatatcggctgtgacctttgtttcttcgtattcgaacgccggcattaacacggcgagaaaacgtttggcaatcagatcgtaaagctttcgttctttgtcgctgaggcttgaaaggatcagcggctcctctgtcggaatgatggcatggtgatccgatactttcgcatcattgacgaatcctttatgcgctttgacgccccgcttcagtatttgattgacgtactgggcgtacggcttaacttccatgccgtttaaacggtcttttaaagtcggcacgatgtctgcggaaaggaatctggaatccgtccgcgggtaagtgacaagcttatgctgttcatacagcttttgaagcacggacagcgtctcttttgcggagaaaccgaagcgcttatgagcgtcccgctgcaattccgtcaagtcgtaaagaccgggagcgaagctttttttcgccgtttttttcaattctgaaatgactgccggctttccttgcaggtcttttgccaaacggccggtcaccgtctgatcgaacgttcttgtctgttttgtttttttatcctgccatgtcagcgtcatctgatcagccgccgcgcggaggccgtaataaggaacgggtttgaacgcctgaatatccgcttcgcgtttggcgatcatcgccagtgtcggagtctggacgcgtccgcatgacagctgcgcgttaaatttcgtggtcagggcgcgggtcgcgttgatgccgacgatccaatccgcttccgctctggcaacagcggaatgatacaggttttcgtactctttgccgctgcggagcttttgaaatccttctttaatcgccttatccgtcacagaggaaatccacagccgcttaatcggtttgcggacgtttgccttttcgataatccagcgggccacaagttccccttcccgtcctgcgtctgtagcgattacgatctggctgacgtctttccggacaagctgagctttgaccgcattgaactgttttcctgtttttttaatgacgacgagctttaaaggctccggaataatcggaagatcctcaagccgccatgattgaaattctttgccgtatccttcggggtcagcgagcgttaccagatgcccgagcgcccatgtgacgatgtagcggtcgccttcaagatatccgtttccttttttatgacacttcagaacacgggccaagtcccggccgactgaaggtttttcagctaatacaactgtttttgacatgcttttcacttctctttctttcacactcatcctgttattataacagacttcctcacgctctctctaatcgaggacgttttttgtgtcaatttctgagaaaatgacgtgggtcacggtttgggcatacggagaggtgcggttgatgaagtgttcgatcgtttccagactgtccgcgttaatcttcagcatataacacgccgccccggcgacccgaaaacaaaattcaatgttgggaatggattgaatgtaggttttgaattgatcgtattttccgtttttcaccgtcgcttcgacaatgcaggagacggggagcccgatctttttttgatcaatgtccaatgtatagcgcttaataacgccgaaggattcaagctgtctgacacgctctgtgacggacggggctgacaatttgatttttctgcccagctcccgcatggacaggcggctgtcccgctgcagctctttaatgatgctcagatccacattatctagtttcatgactgtagtccttccttacccttttggctatattatcaagagaaatccgaaaaatgacaagaacaacaggctgaaatcatgaaggttttttcaggaactgacgcgaaatggtcatattaggactgccctttgcttatagtatagaggaaaaaagatgtccgacaggagggagctgtatgttacacacgccgatcggcagacttcgcacgatggggtttattgaaggaatgtcgcttttggtgctgctgtttatcgcgatgccgctgaagtattgggctcatcatccgctcgccgtcaccattgccggttccattcacggcggtttgtttatcatttatctggcggtgctggcgtatgcggcgtttactgtcaaatggcatgtgaaatggtcagccgccggttttatcgcggcctttattccgttcggtaattttatttatgatcgcggcctgagaaattatcaataaaaaagctcctcttctgcagaggagcttttttcatgcgttacatccatttcgtcacccaggcgatataataagcgccggggatgaatacgagctgggcgagaagcgtgcccgcgacccttgatgtgaccatcgtcaatgaggtccattttaaggagacgtagctgcgcttgcccttcgccacatcgtctgccagtacggagactttcgggtcaacaaacacggccagcagcatagtcgcaacgccgttgattaagcctgatgccataacggccgtcgtgctgtgctcaggcgccagaaggccggcgtacagagcggacagaacaccgatcgtgtaaatagacgtaatgaccatattaatgacaaacaagcgtttcggaatcattcggaattgaagcccctttaaataggagactgacggcagtctgatataagaacgcgcatgcttcagcccgttcagtgaaaatccttttttaaatacctgcatgacggagcctcctccgtccgccaagtgtataatcgccctggagaataacgcgacgaatgtcggcaaaagacagatgccgagcatcgttccgaccgtggagccgaatattaaaaatcgaaactgagcgcccacaacagacagagcgtttgatccggcggcatcaatcagatgtccggtaaacggctgctgaaccatgtttgacatgcgcgacacaataaccatgacattaaataatgacagcgcggacgcgataaatccgactctcgcgccggaaagccgtgttgcataggcaagcgtttcaatcgaatgtatcagcagcagaaaacagaagataaacagtacttgtgaagtaataacgtgcaatgtatgattcctccaaatcttttcatactgattagactctgcagactgcggcaaggtttcggccgtttacataaaaaaaccgcccggatgtccggcgcggttttgtcttattcttttcttacgcaaataaataatatatggttgcccgccttagcctgcgggtgattcgtattaacagttccgacagaatcattcttcgaaagtaaacaccatggaagttcttgaacacaagacaacgaaagccctacctctcaatcgtcactgcggctccgaagccgcgccggtgtgaattgtaaaacaaaaagtcttttttccatctcttcgttaggggcgaatatcagaaggaaaagaataagctcagctttttttcaagctgtccgttgaagcctgaagcttctatatcaaaacagaaaaaagaagtttactttcttttttatttgcatgttgtcacttagcagttaagtataacagattgcccctgaataatcaaatgatttattaaagttccagctcggccggcgttttttcacccgcattcatgagcttgatctgcttcggttcaatttcgagaatcaccaggttcggatcgtcttttccgtcaaaccagcgttccagtttcggatcccacagcttttcttttaaatctgctgagttgttcagtttggcggttccggccacttccacataagcgtcaccgaatccttcacagtcataccctaacagaatatgaacattcggattgttttcaatttcttccgctttatgagtgtctttgctcgtcggcgtgtaaatcgttaagccgtcatggaaaaatgtcatgtagcgtgaatgcggtttgccttgctctaccgtcgcaagcgaaccgactttatgatgatccagtacttcaagcactttttctttgatttcattttgattcatgaagaatcactcctttttaacgtctccgctgttacttttccacattggggagacatttaaaccaagaaatgtgctcttctgccgatcttcgctccattcccgcttcagcatgctgtagttcaccgtgtcatgataggcgccctgtacaaaaatgccttctctcgtcagtccttctttctgaaatccgagccgttccgccaccgccctgcttttcgtgtttttttcagccgcgctgatcatgatgcggttcagcccgaggtcctgaaatgcatgggtgatgaccgcccggcagcttgcggtgataatgccgaatccttcatgctctcgatccagccagtagccgatctctgctttttgattgactgtatcgacattatggatgctgatcatgccgcaaaaccggcccttcacaaaaattccggcgtcaaacccattctcttccgcatatttatagcgccattcggggatgatcacatcgcggtacgtatcgatgtcagccagttcttccgcccagctgagccattcgctgagatggttttgatttcgcttcataacagaatacaattcgtccgtatcttctttggcaagcaatctgatcgtcagatgttcccggatttgacaggaaaacacgaccgcaccttctttcctttattagccattatacaggtaaatttatttttttccatacaaaaaagatgaggcgtgcagcctcatccttaaatgcgcgggtcggtgaaaacatcgtgatcatccgtgcttgtcgatgacatttccgtaacgaccgccccttcttctcccgcttgaaaccaatgcttcgtatccggcggaatggtgtattgtccgcccggctcaagcacaatctcatgccagacggtgtagtattccttgtcttcttccggcgggaggacgcttgggttctctgtcttttcgccttccacgtagagatacaccttcccccagcggcatcggaatgtctcttgttttcccttctcgccgccgaccggcggatggcggtgttccggacacgtctggcgcgggaagagcaccaattctttcgaacagtagcggtcggtattcacgtaaataaacagctgaagcccggtttcctcaagcttgcctaagccgtaatccatgatttgaatgtcttcgacttcatcatcagtcagaacgattcccgctttttgatagtatgcattcacgtcatgtttcgatatcgtcatcggtcagcctccttatgtggtcacaaatctgccgccgttgacatgcagcgtctgtccggtcatataagaggattcgtctgaggccaagagcacatagcagccgacatgctcaacaggctggcctgcccggcccatcggcgtatcctgaccgaaggaagcgactgtttcttctgagaatgtcgccggaataagcggtgtccagatcggccccggcgccacggcgttgacacggataccatcgttgacgagcgcttgcgccatggatctcgtaaaaccgttaatcgcgcctttcgtagccgtgtagtcaatcagctgcgggttgcctgtgtaaggattaatggatgtcgtattgatgatcgcgctgcccggcttcatgtaatcaatcgcttttttagtcaaataaaattgtgagtaaaagtttgtcttaaaggttctgtgaagctgctcgcttgtgatgtctttaatgctttctttcggatgctgttccgcggcgttattcacgagaatatcaagacgcccgaattcttcaaccgttttttcaacggcttcattgcaaaagtcttcctcaccgacatcgccggggattaacagacattttacgccttcttcttccactcgtttttttgtatcttccgcatcatcgtgttcatcaaaatagacgatcgcgacatttgcgccttccttcgcgtaagcaaccgcaacggcgcgtccgataccgctgtcgccccctgtgatgagcgcggttttcccttttaatttgtcagcgcctttatattctttgtattcgtaaacaggcgccggattcatttcgctttcaatgcccggctggcggttttgtgattccgccgggaattccttcggatagttttccatgtcaagttcctccttctggttcgttgtcatatttcttgtctacctctgctgtcttccggataaacatgattgagacagttcaaaacgttttcggagaaaaatgtttcacatggaacgcaagaaaaaaacccggctggcagccgggtttttgttctctattatgaacgtaccgcttgtttgcggagcacgtcttttctcacttttccaaggttgtttttcggaagttcgctgacgaactcaatgtccggaattttaaaggcagcaagacgttcttgaaggaatcgggtcacttcttcttctgtcaggtcttctctgccgtttgtcacgatgaacgctttcggcttttcgccgtagagcggatcagggataccgacaaccgccgtttcgagaattcccggcacttgctgaatgacttcttcaatctggtcaggataaatattatcgccgccgtagatgatgacatctttataacgtccggtgataaagataaatccgtcttcatccacatagccggaatcgccggtatggaaccagccgtctttcagcacttttcgtgtcgcttcttcgttaccttcgtagcctttgaataaaaacggacttgtcacaacgacttctccaattgagccttgcggaaggacttcacctgtttccggatctacaacgcggacgtccacttcttccatcggtttacccgcggaagcggctttatccattcccatttgcggattccaagagctgatgccccacgcttccgtgcttccgtatccgtgcatgagcgggatgccgatgtcgagatactgctggatcaggctgcttggcacctttgtgcctcccgtcatcatataaacgatagaagacatgtcagtctggtgcgtttcccatgctttcagcaggtatgtgaaatagactggcagcgccatgatggtttgaattttttctttttcgatgagcttcaagttttccacagggtcctgattgtctgtcataatgaatgtcgttccgctcatcgtgccgaccatctggcagataatcgcgctcgtatggtaattcggatggcatgctaagaagcggacatgctgcattctccccgtgtaagccaatgtcgcgtttacgtagttgtatatgccgccgtgagtgatcatgcagcgtttcggattgccggttgtacctgaggtaaacatcagcaatgccgtatcgttttcagacaccgtttcgacatccggtgtatcaccggagcctgtcaataaagcgtcaaactcaggcgttgtctccgcagctgttcctgtctcgatcttcagtttaagagaagataccagcgcaggaagaacttcttccataatctctttaaattcagtgccgaaaaagacagctttcggttcacaggctgctaaaatgcctttcatttcgtaaggtgttaattgccagctgaccggcacaacaaccgcgccgatttcgagtgccgcaaacatgacaatggatgacgcgtggccgtttttgcaaagcatcgccactctgtcgcctttttttattcctttatcaagaagcgcttgtgcaagctggttgattcgttttcgatattccgcgtaggtcagggtatgcgcaccgctttttacagcttcgatctcttcgctatttgaaatgtcatgcagaatcatatgctgtaatgtctccatattttcatctcccataatcataaatcacaaaaaactctgtcagattttcttcctcacgcaacccattttaaaccaaaaaatataacttgtaaaacaattttgttttagaactattccattcgtgaatgatacaatagtcccatgtttttagtttcttcccttccccttaccctcatacatgcagaaaaaaacacaccccatatgaggtgtgcgctttctgtttaccgctgtcctttctcctgaatgaaatgataaaacagcttgtttaaacgtttgtataaatcggcttcatcctccgtctggaaggcttttatactgtcttcggactcgatgatggcggagctgaccgcacttagtatttccgacccttcagcgggcatatcagccggcgccatcatcaccaaagcgcggccgacggtcagggaatttccgtccatgcctttgacactgcatggagctgtcaaatcataaattttgaaaaaaggcgtgacaatttcttcatttttgagatggtacagcgccatcgccgttcccggaatgccgagtccgccctgtcgttcacgctctgcaaggcgctgtgcggtttgtttggcattacggacaaatccttcttgctcaagcatggcaaacaaacgattcaaaaacagttcgtacgccgtgtttgactcaatggatttgatcgaaaagttccgcagcacgctttggataaccgccgcataatgtgccatacggccggccgcttccagcatatcaggcgtctccggctgcttctcttctcttttaccgtttctttttttgtcaagaatcagcggaatttttcttttgatgtactgcttcacctgatcagcgtcttcttcgtttaaaagcggactgaccatgacgtaatcaatgtttccatacgggatcggaacggtggatacgatcatgtcatacgcggtgatgtctcggtccttcagttcgatgagggaagacatatcaaaggaacggatttccggaagctcctttttcagtctggatgcgagcattttggacgacccgatgccgctggaacagacgatcagcgctttgatcttcgcttcttcccgtttgatttccagagcggagccgaagtgaagaacgatgaaagcgatctcatcatcagagaaaagaagccccggaaagaatttttccattccttcttctacggccatgtacagcagaaagtagtcgcgtttaatttgctcggtcatcgggttgtacatgtcgatattttctttcacccggttgatcgcaggctccagatgggcgattaaaccgtcgtataaagaaccgttttccgtcagatcaattttgattttttcagaaatgaagccgatcagctgcttcgtttgcaaggccgtttcaacttcaatgttttccggtttgaattccgttttgtattggcggttggcgctccgcaaatgaatggtgatataaccgatctcagcttccggaattgaaacgccaaacgctttttcaagctcttttgccatttccatcgcagagccgtactccttcgtctgctgcagcgcttttagttccgaagcctccatcgtgatggtttctccgagtctgattcggtccatcgcaaaggttaaatgaaccgcaagcgccatgtatgagctgtcagataaggcgatcgcgattttttccttgagctgaatcaagagccggtccattttcaaaagttccgctttatttacgaccccgaacattttttcagcatcgtcaggttttcctttaatattgaattcaaccgcttccaaaaagctctgaatatcaagccggttgacgatgagattgccgacgattttccgtttcgcattttccggacccgtcagctgtatgccgaagcccctttttcggatcagcgtcaagccgaagggcgcgatccaggtctccagctcatccagatcataactgattgtcgcgtttgtcacttgcaattcgttcgccagactgtagagcttgatcggctcttgcgactctaatagtgaacatagaattaaaagtttccgctcctcagcgctgtattcatgctgttcataggacaggtctgacaggagtttttgtttgtcctccgggtttcctaccgctttcagtcctttgccgggctgtttatcaagtgccagaccgaatgattccatcatcggtttgattgtttttaactcgcggtgaacggttcttgtgctgacttgtaaagcttctgccagttcatgcactgtctcgtaacggttctgcagtaatagatgtttcattaatttttgttctctcgctgtcatatacatgaaacgcgcctccagattttctagttgtgagaagtatggcatatggggagtgctgccggggaaagtggtgtaaattataatataaaacgctttcaatgattattcaaccattttcaaatggcaatttggcactggaccgtgtgacagtattgaaaaagaaaaatgtgtcagataatatgccatgacgcttgttactcttgatccgcacggctatacttcaaagtgaccttacttgtttttagacattgcacaccacataaacaaacgcccggaagataccttccgggcgtttgttctgtttatggaatatcgcagccttggacaccggtataaatcctgaaccactgatcatggctgagtttgtacgcggatgcacgcaccgcggcggaaatgcggttctcttttccgctgccgacaatcggcatgatgtctgccgggtgggtgaacagccatgcgtacatgacttcgtcaatggaagcggcgccgatttcttcctgtacggaacgaagcgcggcacggattcggagggccttatctgattgtcctgtaaagacgctcccgcccgcaagcggtgaccacgccatcggcggaatgcgtttttccagacagaaatccagcgtgccgtcatgaatattttccagcttgtacgccgagatttcaatttggtttgtgacgagcggatcatccaaataggattcgagcattctgtactggtgcgctttaaagttcgataccccgaaatatctgaccttgcccgagcttttcagcgcgtgaaacgcttcagccacagcctccgggtccataagcgggtccggtctgtgaatgagcagcacatccagataatccgtattcagattcaaaagcgactgctccgccgacgctaagatgtgagacttcgacgtattataatgatgcgacttgtttcctggccgctccggtgattcaatgacaatcccgcattttgtgacgatttcgattcgctcccttattgaaggcgaaagggacaaagcgccgccgaacagcttttcacacgtataaccgccgtatatatcggcatgatcgaaggtggtgatgccttggctgatacaccattcaatcagattcagcagctctccgtctgaaacattccattcgttcagacgccaaagcccgtgtatcactcttgaaaattccaggtcttcagccaattgaatgcgctgcatgtgaaatccccctttttcttagagcctcttgtatctctgttttcaggaattgcccatgctgtttcattctgcttcggcggccgattttcctttcagcccgcaaaaatcgtcatttaatgattctgaaactgctttttcgctttttcaacgacgtaatggcttccgccgcgttttttgacgtcttgaatcatcatcgcgatcaagaggtctttctttttataatcgtaaccgacaaaccagccgttttctttgccgtctttatcttctttagacgttttcagctcggctgtaccggtttttccggctacggtaatgccgcttacggccggctgatatgcagagccgcgcggatcttcaacgacgcctctcagccctttcgtgatttcttcggcattggctttcgacaccacttgcttatgccagatttgcggtgttttttctccgtctttgatcaatgtcggtttgacgagatttccgtctgttacaaatgcggtatagtcagccgctaagtgcagcggagacatcagcatctgcccctggccgtagcccgtatctccgagaaggatctcggaatctagcttgccgttagcgattgaggacttttcaatcggaaattggtacggaatctcttcatcaaagccaaatgtttttaatccttttgtaaacgcgtccgctccggcatctatggcattttgcgcaaagtagatgttgtccgatgtgatcagcgcgttttcgagatccacttcattcaggcgctctgatacgcgtgtgacatggtaaccgccccagctcgaatctttctgccactcttttccggtgatttttttcttttccgatgctttcaatgtgccgtttgtcaggccgactgccgcggcaatcggtttaatcgttgatcccggcgcataaagtttgttgaatttcgctgaaaacggattgtttttatcttcattcagctttttccactcttttccgctccagccgaaaagaaagccgttcgggtcataagacggtgcgctgacgagcgcgagtgtctctcccgtttgcggttcgagggcgactgccgctccgctgtcatctttcatagaatcatacagcttcgtctgcgttttcatgtcaatcgttacatgaatatcctgcccgctttcggctttcttttcagcaatgacctcacctgtttgcgggacgtaaattttccagccggtcttgccgcgcagcttgtcttcatatacattctcaaggccggcgatgccgattttggaagtatcgctgtattggccgtctttcgcttttttcagctgctccgctgtgatggttttaatatagccggtcagatgggccgttttttcgccgtacggatagtagcgggagctgactttcgttttcgtcacgccgtctaatgcaagcaggcttttgaccttgctttcatcatccggtctgattttttgaatcgggacataggagtcgtcttttacccagccctggttcagtttgcttttgatatcgtcttcagaaaggtccagtttttcagacagtttttggatcacgctgtctttatccttgccgagttttccagggataatgccgatttccggcacctcggtattcacggcgagaccttttccgtctttgtcgtaaatttgtccgcgcttcggttcctcatttgcgatctgcacggttttgtcatcggaaagctgtttgaaaataaaagaaggattccagtcaatgttccatgattctccatcgtctgttttctcttttttcaggacggccgtgttttcaaaagcgaccttccctgcttttgtatccatgctgactttataatcgatgtgctggaggtcatcttttttcttatcgtcttcgtcctgtttttcggcagtgactttcagatttttgacccctgcttgttcataaatggtttcatatcgttttacaaaatcctttttggatcgttttttcttttcatcctgggtgaggctttggtacatcttatcgtaatgaccgccgttccagtcttttacgaaatctttcattctgtcttcggccgattccgttttcgagcagccgatcaaacctatgattcctgcgagtaaaagtaataggtataacccttttttcactgtcaattcccctgccttccaactgttattttctcctaaaccaaatcaggctggcaaggatttttttctcatagcgtttaaaatttttttgtttttccggccgtcacggcccatatttttatacaatgtatctattaaaaaaggaggaatttcagatgatcagagaagcagccatgctgtatgtaaaagaaggtcttgagggggaattcgaagaggcattccgccgggcggagccgattatcgcgggcatgaaaggttatctgtcccattccttgtccaaatgtatggaaaagacgcataaatatttgctgcttgtggaatgggagacattagaagatcatacaaaaggctttcgcggatcgccggaatatcaggagtggaaagccttactgcaccgtttttattcaccatttcccgttgtggagcattttcaggatctatcagactcagatcgcgtgaagcgtaaaaccgattaaggagatcgaccatacaaaaacggcggtatagatattgaatttcccggagccgtcgttttctttccgtttttcctccagccctgaatgaacatgaccgcaccgagaaacacgagcataaccggctgtatgacggaggtatgttccgcatacgtaaatgcggcggccgcaagtataataatcagcatcgcgagtgacagttttaaggcgcgcagcaaagcaatccatcctttctgttatcattttttgaacacaattctatttctgtctttatcccccattattctagcgtactttttgcgcggatagaacgaaagtcggacaattttaagtttgttttaaggagcacgaaaagcgcgctccccatgaaaaggagcgcgcggtttatgagcgggcgaggcttccgtatccgagcccccgcaggacgcatgccatgacttcataccccttgctgttggggtgtacgcggtcataagaaagatattcattcatttttcctttgaaagcgctgtggacgtcggcaattttgacgtgcggcgccgatgcgagtgtgctgaggtgcgcattataagaggatatccatttttctgcaatggagatgcccgggaaaggattgtataaattgaagacgcggatctcataaggagacgggtgcgacccttttaaggcagcaatcttggttatcatcttttcaaagttctcatggcagtgactggacacgctggtgaataccgaagcgtccgatgtttgctgatatgcctgaaccgaatcgatcaaatcgttgccgcagcctgtaatcgtaatcatatcagcagcctgaatccgcctctgaatgtacgggaaggacataagcccgagaatttctcccgtctcaaggcctgatttggcaaagatggatacgtcggttcttgtctgtaaatcttctgccatcatgcgcccgaaccgctggacaaaaccggcggaaaacggcccggatcccctccccgtcgtcaaagaatcccccagcgccgtataaacaagtcccatttactttcctccactcgttactatcgatattgtaatgtacgcgagtgaagaaaaattggctcggtcaataacctaatttctcagaaatatgctgtgcggcgtttttgaccttttcggttaaatacggcagcctgtcctctgaaaaccgggcttcgaagccggcgatgctgattccagcagccaccttaccttcgtgattgaaaatcggcgccccgatcgccgccgtataatcttctaattccgaatagctgatcgtataacctgattgcaaggatctttcaatggagtgaagcagttcagcccgatccgtcatcgtgcctgaggcgattgcggcaagctttgtcttctgaatgtatgtgtcaatctcctcttccggcagaaacgataaaatgcttctggcgcaagctcccgcgtacagcggcgaccggcggccgattgccgtatacaggcggacggtttgggtgccttcaattttttcgacgtaaatggcttcatccccgtccctcatgatcagctgaacggcctcatccacttcgctgcacagctcttccataatcggtttggctattttcctgatatccagacgttcagagacgagctggccgaattgtaaaaagatcagaccaagctgataacggccgtccgccgcccgggtgagaaaccctgtttcctccagtgagcttgccatccggtgaaccgaagtcttcggcatttccgatagagaaaccagctcatttaagctcaggctcggttcagtgagaaacaaatgaagcagttccattgatttgatgacggttttgtttttgttttccatggtctttagcccctttgtcagatcagccattccattttgagccttgctttcagctccttcagctgctgttccttctccaaaagcagcatttccgcttcctccagcgaaacggcccggaacgtaatatgttcccccggcatcgtttgggcgacgaggggaagatcggcggatatgatatgcgccattcgcggatagccccccgtcgtctgtctgtcagccagcagaataatcggattgccgtccggcggcacctgcaccgttccgaacgtcacagcctcagataccatttccagcggctcccgcaattcaagcggagcgcccttcagccggtagcccattcggtcggattgaggcgtgaccgtatatgactcttgataaaaacgtaattttgcttcttctgtaaaagcgtgaaattgagcgccttcaagcactcgtatgaccggattttttttcagcggcagaaaccctctgctgctgacagaccaatcaggcgctgagaaaccatactgtccgaaagaatcgctcagacggtacgcgattgattccgaacatggcgtcatacggccgagcggcagctcatcatctttttgcagcgctcttccgcaaaagccgccgatccccgctctgacatacgtgcttttgctttccatgacggcgggcacatcaaatccccccgcgacggcgagataagcgcggctccccatcttgcacggcccgaatgagacgacgctgttttcctttatcaaaaccggtttccacagaggggcgggctccccattaatatgaaaggcgaaatccgcccccgtaacggcaataaccgcgggttctgagaactcaaaggaaggccctggccccataagcgtaacttcaagccccgcctctttttcttgatttccggcaagaagattggcgatgcgcagagagatcgtatccattgcgccgcttcccagcacaccgtatttctgatatcccgtccgccccgtgtcctgaaccgtcgtcaagagaccgggttttaccactttcatactcattcggctccctccttgatgcggctgtactcctctgctgtgatccggacgaatttcaccgtatcacccgctctcaatagactcggcggatgttcttccggcctgaaaagccggagcggggtgctgccgatcagctgccagccgccgggagtggatatcggatacacaccggtctgcattcccgcgattcctactgaaccggccgggatggacggccttggcgacgcctttctcggcgctctgatccgctcagacattccacctaaaaacggaaatcccggcgcaaatccaagcatataaacgagatattcgccttcagtatgaatgcggatgacgtcttccggggtcagatcgttcatttcagcgacctcttctaaatcgggaccgaaatctccgccgtagcaaacggggatttccatcacccggcgctcttttttgcggccggtcattatatggctgagacgttctgtcacttctttcttgaccagggcaaaaggagagacgcctttttttatgtttgagacggcagacacgtcataaaagaccgttaagcttgtgaatgccggaatacattcaacgaagcccggaaacggccgttcttccatacaggctgccgccgcctgcacccggctgttgacctcttcgctgatgtgcccgccaaagcggatgataacggcggaatcaccgtacggctgtatatcaagcgctgtatttccgctatactgcatcattgtcatcacctcgttgtattctttctcacttacaggacagcaagcgattcattttgtatatcggtgatcagcatgtgccccggtgaatgtgttattacgatatcaggctttgcttccatgatcaccgcctggggtgtaacgccgcaagcccagaatacgggaacttcaccttcccgcaccgttacggcatctccgaaatccggctgatgcaaatcgctgatgccgatgctttgcggatttccgatgcggacgggggcgccgtgcacggcgggaaaacgtgacgtgacctgcgccgcgcggactgccagcctttccggaatcggtctcatgctgacgaccatttttcctgaaaacgggcccgccggaatacagtcaatatttgttttatacatgggaacgttcacgccttcatcgatgtgcctgatcgggatgtgctgattaataagggcctgctcgaatgaaaaactgcagccgatcaaaaacccgacataattatccttccaatacggcgtaatatccgttacctcttcagtaagcacgccatgccgataaatcctgtatttcggaaagtccgtccggatatcagctcccggcgccgctattgccggaacgggtgaacccgcatccgtcacatcaagcaccggacaaggcttttgattacgctggcagaataagagaaaatcaaaggcaagatccttttgcaaaacgacgagattggcttgtgcgtaagaagcggccaaccccgccgtcggcccggtcatctgccctttcctgataagctgtctgacttcttcgggactcatatcactcatatggtttttcatatcatcagctccatagctgcggcatttgcgagaataatgtatagatgcccataaccgccatgacaaccactacgatcgcccctgcaatcgtgagccagatcggatgcttgtaatcgccgacgatttttttcttataggcgcccaacagaatcatcgctaatgcaagcggcagaattaagccgttaagcgaaccgaccgcgaccagaattttggcaggctggccgatcgtgacaaaaataagagtggatacaataataaaaccgataattacgccatgtgagtgcttttcgatttttgccgaaaacgatttgaagaatgacaccgatgtataggcggcgccgatgacagacgtgatagcggcagaccacatgatgacgccgaaaattttatagccgacatttcccgccgcaagccggaatacagaagccgcgggattatcaggatcgatgcgcaggccctttgaaacgacgccgagcacggcgagaaacagggcaatccgcataacagatgtaatcaagacgcctgtgacggagcttttcgtcacctgaggaatgacttccttcccttggatgcctgaatcaagcaagcgatggcctccggcaaatgtaatgtatccgccgaccgtgccgccgacaagcgtcacgattgccagcacactgatatgatcaggcataaaagtttttacaaccgcgtgtccgaccggcggacccgtcgttacggcaacatacaccgtcaatacgatcatgacgattccggcgatctgcataaaacggtccatgacttttccggcttcctttatgacaaaaatcagcaccgcgaccgctgcgctgattaaagcgccgatctccggtttgattccgaataatacttgaagaccgagacccgcgccgccgatgtttccgatattaaacgcaagtccgccgagcacgaccagaaaagcaatggcataaccggcgcccggaagcaccatattggcaatctcttggccgcgctttccggaaaccgcgataatccgccatacattggtttgcgcgaaaatgtccaaaataatagaaattaaaatgataaagccgaagcttgccgccaatgtattggtaaacgtggccgtttgcgtcagaaagccgggcccgattgatgatgtcgccatcaaaaatgtcgcgcctaaaagaagcgaccatttgccggaagcctttccggctgtttttttcttttgctccatgctgtcttcctccctctgctgctcagtcttttgcaagcgcgctgatttgaatgtctgccgcttttaattcttttttgattgtttttgcgaatgtcagcgcgtgggcgccgtctccgtgaatgcagaccgtgtccgctttcaggtttacagcttgtcccttacgtgatgtcaccgtgctgtctttcaccatttgaatcacttgaccgaccgcttttttgtcatcctgaatcagcgcatccggctctgaacgcggcgtcagcgtgccgtcttcctgataggtgcggtccgcaaacacttcgcttgccgtcctcagtccgattcgatctcccgctttaatcagctcgcttccggaaagcccgaaaagaataagcccgggatcaaaatgacagaccgcctgagcgatggcttttgacaggccgggattgacggcggccatattatataaagcgccgtgcggcttcacatgctgcatctcgacaccttccgcttttaaaaaccctgacagcgcgccgatttgatacagcgtcagatcatacgcttcctcgggcgtaatcgcgatctgccgccgcccgaatccctgcagatcgaacagcccgggatgagcgccgattttcacgcctttttccgccgcaagcgcaaccgttttgcgcatcacgctgggatcacccgcatgaaagccgcaggcgatgtttgcagatgtcacataatccaaaatctcttcatccagtccgattttataagcaccgaaactctctcctaaatcacaattgatgtcaatctgaaacataagctccctcctgtattgtaaacgttttattttattatcattccgatatttggaacgactattccgaattgttggatttctcttcattatatttaattctgacaagtttgaacatccttttgtcagaaaacctaccatggacctagtcacaaatctgacaaaacaaaaaaagagagcctcatgctgagactctctcttttttctattataacacccagtggcggatcgctttggcgaccccgttttccgtgttgacatcagtcacccagtcagctgtttctttcacgatgtcctgcgcgttccccatggcgacgccgacacccgctttttcgatcatggcaatgtcattcagactgtcacccatggccatcacattttccatcgtgaagccgagtttttccgataccttcgccagcgcagccgctttgttgataccgagggcattgacttcgatgttgatcggacttgagtttgtgatttcgagctccttgtattccttgagctctttcagcacctcattccgcacttcatcatcctcgatttcgaacccgaacttgagccactgatgatccgtaatcgtttccgggaattcccctctccacactctatcgacggtagaggcccagaaattcgtgttgtgcttattcctcagatcccataatttttgaatatgatcggtatgaagaagcttgcgctcaaccagctcaaagttggaatcccagatttcgctgccgtttgccgtgattaaaaaggatgacagctcgagagactcagccagttcgcggcaggtcatcagcgtgcgtcctgtgctgatgacgacgtgaattcctttcgcctccgcttccttgatcgcccgccggttttcctccgggatgagctgctcgtcattgagcagggttccgtccatatcaatcgcgatcagtttaatatctgcgtcttctctttgtatcggcatatatgtacctcactttttatattgtagtcgtctctattttaatacatatgacccacaggaacaaaaaaccgcttcctgcgtttggcggggcgagcgttgaggaaaagaaatattgaggtgatggaggatgaaagaaagaaaacaaaagaacaaaccgaatgaaaatcctgaacatcatgatttaacggatccgattccgctggaagagctgaaggaaaacgccaatgacgaaaaacacaaacatgaccagagggacaattcacaaagtgagagagattatgatacaaaataacacgcttgtccgaaagccgccggtggaggcggctttttttacgatggctggataaatatgctgagctccgcttccgccacaggcttcccggcaacggacgctttcgcccggccgaacacaaaaccgcgtctgattcgcgtgacctcaaaaaaaagatccagacggtctcccggcaaagcggcacctaacctttccgctttcttcaccgcggataagagaccgagaccgtcaccgccggtaattcccgcgcaagccgccgtttgggccattgcttcaacgacgagcgaaaatggcatctctctttggtattcagttataaaccagtcattttcactgatgtttttgtaagcagccgcccattttccggcttcactgttcgtcgtgccgtcaatcaaaagaaacggaaaacgatggggcaatagcttctgattcatcacgcagcctcccttccctctcattataacgcaagaaaaaacccgcgtcccccgacgcgggttcatttttattgattgagctttttgagcacgatgccgtgcagcggttcatgcggctgaataccgcaaatgtcttgaagaacgccgctcgtgcctttttccgcgataagcttttgcagctcaaccgcttccggatcatcctgatagtcaaagcgcagggcggcggcgataccttccgccagcgcattcggttcttttatttttttggccggccctactaatctgtcattcgctccgagttttctgagcggtgatctggcgactcttgtcacatcatccgtgatgtattcattatcaaagcggctgatgattttttcatgtactgctcgtgttcggcttgcttaaagccgtacgctttcaccaagtactcgcccgtttctgaaagtgcatcgtacacgacacgccggatttccggatggccgatggcctctttgacggtttttaatccgcgctgatagccgacatacgccgtgacggcatgcccggtattgacggtaaacagctttctctcaatgaaaggcgtaagatcatccgtaaacaacgcgcctttaagtaccggctgatcgccggcaaagccggttctgtctatgacccattcaaaaaacggttctacggatactttcagcggatcttcatggtgctgaatcggcacgatccgatctaccgcagaatccgggaagccgactgtccggttcacgagttcccgctccgcttccgtcaaatgtccgaaaacttcttttttcagaaaactgctgccgccgatcatattttcacaggcaatgatattgagaggctcagaggacgttctgcgcttcagaccttccgcgatggacggggcgatgagtctgagaacgttcgggcccaccgccgtcgtaatgatcgccgcttcattgatcagcccgtacagctcttgttcttgcaccgcgctgttgatggctgaaacggggccgatgatttctgtctgcctgccgccgtcggcaagctccacggtatattccttcttttcattgagaaggctgaccatcgtttcattcacatcagcgaaaactacgtcatagccggaatgatggagcagggcgccgataaagccccgcccgatgtttcccgctccgaaatgaagggcaatcatgtcagttcacctcgctgaaaatagcggccagttcttcttccgtctttgcattgatcagccgttcgatgttttcttcctctgagcagatgatggcgatgtttgacaggatgtctaagtgttcattgttttttccggcgataccgaaaacgacctttgccgtattgccttcaccgtattccacaccattcggaatctggatgacggaaatgcctgaatgaagcacctcatccttcgcatcttctgttccgtgcgggatcgcaatgaaatttcccataaacgtggatgatgtttcttcacgttcgaacattttttccacatagccgttcttcacgtaaccgttatcaatcaacgtctgtcccgccaggcggatggcatcctcttttgagttcactgtctggttcagtttgatgttcgctttagccaatacttccatgatgaagatccctctttctgtttgattagtttttaagcttttcaatcagttcatcgtatttcgggctgtttaagaaattatcaaccgaaatgtgcaccgcctgcggcagcttcgctttcgcgcggtcagtcaggtccttatgcgtaatgacgatatccgcgtcattcggaagattattgatcgacgtatttgtcacatcaatatccaggtctgcttttttcactttgtttcttaaaatggaggcgcccattgcgctcgatcccatacccgcgtcacatgcgaagataatgcggctgacttggtcagcggaaatatcagcggcgctgttttccggctcttcctctttgtctgccaatgcggccgccgcttcacttttcctgcctttcatttcctgcattttttccgccgcggctgtcaaatcttcttcgcccgctttagacgatttcagaataagcgccgagacgataaacgatacggccgcagccacgatgacgcccgccagcacgccgagatagcttcctttcggcgtcagcgccaaaatggcgatgatgcttcccggagatgatgcggcgacaagacccgcgttaaagatcgagaatgtgagcagtccgctcgctcccccggcgatcgccgcgaggatcagcatcggtttcattaaaatgtaagggaaatagatttcatgaatcccccgaagaaatgaatgatcgccgctcccggagctgtcgatcttgaagagcctttcccaaagaacatataggccagtaaaataccgagtcccggtccggggttcgcttccactaagaacagaatggattttcccgctttggcggcctgctcgattccgatcggacttaaaatgccgtggttgatcgcgttattcaggaacaggactttcgccggctctacgaaaacgcttgcaatcggcagcaaattcgcgtgaacaatgacttccacacccgccgccagcaatttgttaagagacaggacgaccgggccgatcgcataaaacgcgataatcgtcagcaccgcgccgataattcccgccgtgaagttgttgatcagcatttcaaaaccctgtctgactttatctttaaacagacggtctaattgtttaatgagataaccacccaaaggtcccataatcattgcccctaagaacatcggaatgtccgctccgacaatgactccgatggcggccgtcgctccgacgactcccccgcggtgatcatagatcatttttccgcccgtatatgcgattaaaagcggcagaagatacgtaatcatcgggcttaccaatgtattcagctgcggattcggaaaccaccccttaggtataaacagcgcggtgataattccccatgcgataaatgcgccgatattcggcatgatcataccgcttaaataactgccgaaccgctgtatcttcactttcatgccagcttgctgttcttgctgcatgttcattccctccctgtttgcctgccttcagatgaaaataaataagacacggggtttctctctcccctgtgtcttcatcataaaacgcttacaatccccattcaatgaaaagtaaagaggagtttggcacagagactgtgacaaatccttaacaaaaaaaagacacctcatcaaaggtgtcttaccgctttctgtatataatgtgtccttttgtgacgacgagcttggcaatgagccgctcactgacaataaacaccggatacgcacatacgagcgcgaaaatggcggccggcacataccgcgctgccggaaacatcggcatgacggcggttctggccatctgcacaagataaatcaaaagcaccgtgatcgcaatggccgcagccataatcggagctgatactttatattcacgcaatttcacatggcaatgcccgcactgaaactggcacgggatcatcgatgatctgaccatgtcgcctgtaatcggcttgccgcagttcgggcaggtcgtttctttcatgtttattcctccattcaactcttctattataacagagtctgactgcgtgttttacatttgtgattgttcaacattttttcacatattttatcatcaggctcttgtgtgcatttgtgaaaacatctactcttagagggaggttcatcactcattcgcataaaaaggaggatgcagaattgcttccgattcacagacagcaaaccttgcttgaatggctgaaagaagagggcgcgctgaaaatctctgacataagcgagagattcggcgtctccgagatgaccgtgtacagagacgtcaatcagctggcggatgcaaaccggattatccggacacccggcggcattacgctccctcccgcttcagaacgaagcgccaatcaatgcggctattgcctgcggccgattcagcattcgtattctgttcagcttattaccgtttcacaaaccgttgagcagatgtgctgcattcattgcgcgattttgcggtatgaggataaaaaggatgaagtgtcccacgtcatttgtaaggattttcttcttcagacgacgctaacggcagcttccgcatactttttagtccatgccgatattgaccttcactgctgccggcctcaggcgattcccttctcaacgcttgattacgcagaacggtttcaaaaaggattcggcggggtcatttgcacctttgacgaggcggcggacatcatcttacacgacaggcagaagggatgcacctgcagcaagacataacaacaaccaaccggaaggcggtgtcatcatccatgagacagaacaaacgctggctcgtctttttgctgttccttgttttgattccgaaaacaagcttcgcccacgcctacatcacaaactcaaatccgggtgagaacagcgaattaaaacaagcgccgaagcagattgaaattgagtttaatgaacagattgaagaaggcttccactccattaaggtctataattcatccggtgaacgggttgacgcgggcaaaacggtgattcaaaaaaataatgcccgcatcatgaccgcggcattgaaaaaaaatctgccgcatgatatttacagagcggaatggaacgcggtatcggccgacggacatccggtatccggcgtcatccctttcagcatcggaaaagccggcggagaacttcaggagcagacatcatcgcaagcggcgcttcatcccgaagcggccatcgaccgcggtattttgtacaccgctctctccctgtttatcggcacggcttttttccatctgttttggtacagaaataatgaagattcatcaaaagcaaaacgaactgtaaagctgctcgtgatttctttatgtttaacggggctcgcgctcgtgtgccagctcccgatccagacgaaagaaaacgcgggcggcgcttggagcgccgcgtttcagccggactatgtaaaagaaacgcttctgaaaacggcaggcgggtacgtctggatgatccagatcagcttatttatcctgctcgccctgtccatgatcccgctgctgaagaagaaagcattccggtcatttgcgtactggacggcgccgctgttattcttcttcgcttcgcttttggcaaaagcattcgccgggcatgcggccgttatcgacgaaaaagcggtcggcatcgcaatggactttctccatttatcggccgcgtctgtatggatgggcggtatcgccgcgcttgtgctgcttctttcatcagagtggagagaacccgataaaaccatcgcttgggaaacggtcagacggttttctccttgggcgttcgcctctgtcggcgtgctgttattttcaggagtgctgaatggatttttcattatccgctcgttcgattcactctttcacaccgcttacggcaagacgctccttttgaaaatcggactgtttgtcatcatgcttgcgctcggcgccgttcacgtatggatgacgaagttcagcagaaaaaggagcatcagcgcaacgataaaggccgaatgggcactaggcattgcggtgttattcacaaccgccgtcttcacaagcctgcccagtccgcctccgcccgcgccattgccttttaacggctcagaaacgatcggaaacggggaaaccctatccttgcacattacgccgaaccagccgggtaaaaatgaatttcaagtcattgtcaccgatcataacggcagcttagtaaaagacattcagcaatttacggtcactgtttaccagacgggcttcagcggcaaacagcatgaaagcacctttgatttgaagaagacgaaggaaggcacattcgaagccgccaacctgtccatcaccgaaaagggaaactggaagatcaaagtccacggactgacaaacgattttaatgaaatcaaccaaatattctcaacgacaaactaaggagtgtatctcatgttgaaaaaaaaagctttaatattcatatccgccgtgaccctgtcactcgtcggttttacggctgcagcaagcgcccacgtctcagtcaaacccgcggaatccgcggccggttcttgggaaacgtacacgatgaaagtgcctgtggaaaagaatgagccgacaacgaaagtcgtgctgaaaatgcccgccggcgttgaatttcagcagtatcagccgattccgggctggaaaacatccgtatccaaacatgatgacaaagcggtctccgtcacttgggaagcaaaggacggcggcattcagcccggccaattccagcagttcacgttcgttgcgaaaaatcctgaaaagagcggagatgccgcttgggacgcttaccaatattacaaagacggcagcattgtagaatggacgggtgatgagaaagccgacacgcctcactcgattacgaaaataacgaaatcggcgagcgtgacggatgcgcacggagctgaacagtcaaacgaagaaagcaaatccggcgtatcagcgcttgatattgcggccatcgttctgtcagctgcggcaattatcctttccatcgcggcgcttgtaaagaaaaaacgtgtgtaagcaaaaagcgatccggctctaaagagcctgcgatcgctttttttcttatccgcggcctgcctggaaagacggatatttggtcattcccccgtcagcaaacagcgtaatcccggtcacatagcttgattcctttgaagcaagccagacggcgacagccgcgatttcttccggctcaccgatatatcccatcggaatcatgctttccacatcttttttctgaacgggatcggcaaatttttccgcgttgatcggcgtattgatggcgcccggcccgatgttgttgacacggatgcgcttcggcgcgtactcaagcgccagcgtttccgtcatcaatttgatgccgcctttactcgccgcgtagtggacaaacagcggccacggaatcatctcatgtacgcttgacatgttaatgacgtttccttgaatatcattctctacgtaatatttaatggcttcgcggcttcctaagaaagcgccggtcagattggtattgataactttgttccagtctttaagcggcatttcatgcgactgaaccggattttccatgccggcgttattgatcatgacatccaatgtgccgaattccttcactgcggtctgcacgatgtttttgacatcttcttcttttgtgacgtctccttgaacgatgaccgcttcgcctcccgctttttgaatctcttctttaacggtttgggcgtctttttcattactatagtagttaaccacgactttcgcctgctcctgtccgaagcggatcgccatcgcttttcctaatcctgatgaagctcccgtaatggcaacgacttttccttttaaatccgtgtacatgttcaaacctcctgcatatgttatgaatttgatttcgcaacgcctaagaataccgcggctacaatgatcaggataatcccgatggcaatggcgaccagctgacgcttcgttttgctctcacggagaatgaagattccgccgagcgtgctgatgacgatccccatttgagagagggaaaaacttgtcgcaactccgacgcgcggctgtgagatgaacagaaacatgttcccgagcgcccagatgattcccggcagaatgttcttgagggcgtacttattaaacggtttatgcttgtacgtcaggagcagtccgccgatgaccatcccgatcgcctgcggcagaagcgctgaccatccggatacaccgaacagccgggcgacgacgacatagaccaaatagccgagcgtggagatcagcaggatgacaatgcctttttttaagtttcccggttctccgtccgcccgcccctttttatcttctaaagatgtgagcacaatcccgatgatgataaaaataagggcgagaatacccagcgtaatcgcgatcggggttgaccattctttgaatacgatcacaccgaacaaagaagtcgagacgagctgcattcccgttgatatcggcatcgtttttgaaacgcccatcagctgtatgcttttaagctgattgctttggccgagcgaccaaaacagccccgagatgatgccgacaataaaaatgcgcccggacagcaccggatggacaaacagatacagcacaaacgaaacgatgagcgccccgattgtcgttcccagcgtctggctgtaaggcccgccgcctaatttgacgttaaataacacgatgctcccccaaaataaagccgggagaagagccagtaatatatccatgatggcgaccttctttcaatcgtatttgctgttattttgtctggaatcgaaccgattattcccgcaagatcaaaaaagcctgccggcgatattcaccggcagaccgctcaataaaaaagccccgcttagaagcggggctttcttttcggctcattaaagtccgatagacatgtatttggtttccaggtacggttcaatgccttccgtaccgccttcacggccgatgccgctttctttcattcctccgaacggcgcttgaaccgcggacggaccgccgtcattccagccgatgataccgtattcaagctgttcagaaatatagatgccgcggcggtagttttctgtgaagaaataagccgcaagcccgaacggcgtatcgttcgcaagcttgatcgcttcatcaatatctgagaacgtaacgatcggcgcaaccgggccgaatgtttcttcatgcatgatgttcatggatgtatctacatttgaaagcacggtcggcgtcacgaaatagcatcctttttcgtcgttttggtcatacgttccgcccgtcagcacttctgcacctttttccacggcgtcattaatttgcccgacgattttatcgaagccttttttgttgatgacagggccgacgtttacgcctttttcaagaccgtttccgactttgagtttcgcagcttcttcactcagttttttcgcaaactcgtctttcacggattcgtgtacgatcagccggttcgcacagacgcaggtttggccggcatttctgaatttagaggccattgtttgggctaccgccagatcaagatcagcgtcttcatccacgatcagcggcgcatgtccgccaagctccattgacatatgttttacggtgtcggcgctgtttttcatcaggattttgccgacaggcgttgagccggtaaaggtaattttacggattttcgggctgctggtgaagacgtttccgatttcggctccgtcaccgatcaccacttgcagcacgtccttcggaattcccgcttcatatgcgagacgcgcaagggcgtaagcggaaagcggcgtatcctccgccggtttgatgatgaacgtacagcctgccgccaaagcgggcgcggcttttcttgtaatcatcgcattcgggaaattccacggcgtgatcgcggctaccgggccgaccgcctgacgggtgacgacaatccgtttgcccgttgtcggcgcaggtacggttctgccgtaaatccgttttgcttcttcggcgaaccattcaatatagccggcgccgtataaaacttctccgaccgcttcttcgtacggtttgccgttttctttcgtaattaattccgcaagttcttctttattttcaacaatcagctcataccattttctcaaaagtgaggcacgttctcccgctgatgttttggaccatgattgaaacgcttgatgtgaacgttcaatcgctttttcaacatcttcggccgtctgctgggggatgctttcgatcgcctctcccgttgccgggttgtacactgttaattgttctggcatattgaacattcctttctttcctatagtaaaaccattgaatgcttgttgatgtatctcacactttcatgatagcagacacatccggcgggattccaataattgaactcacagagctgcttcgataatggaaaggccttctttgagctgctcatccgtcacgacaagcggcgtcaggaatcggataatgttgccgttaatgccggccgtcagcagcagcagtccgttctcgttcgccgttttagcgatcgccgcggcttttgctttgtccggttcccgcgtgtacggatctttgacaatttcgatggccgccatcgcgccgagtctgcgcacttctccgatgcaggcatgctcttttttccactcgatcgcttgatgctcgatgatccggccgatctcttcggaacgctgattcagcccttcttcttcaataatatccaagaccgcgagcgcagccgcacagccgagcgggcttcccgcatatgtgccaccgagttcccccggcgcggcggcatcaagcatttccgcccggccgatgacaccgctcagaggcaatccggccgcaagtgatttggatacggtgatcaaatccggaacggcttcgaaatgctcaatcgcaaaatacgttcccgttctggcaaaaccggtctgaatctcatccgctacaaaaacgataccgtgttttttacaaaaagcggcgacgtgctgcacgaaacgttttgaaggaatgatgaagccgccttctccctgaaccggctccattacgacacaggcgacggtttccggtgcgactgcggcgataaagaaatcctcaaaagcgctgatgataaagtcgtcatactgctcgtcgctcatgccggccggcttttgataatagtaaggaaacggcgcttgatacacctctgaggcaaacgggccgaaaccgtatttataaggcttcaccttgctcgtcatgctcatcgtcatgttcgtgcggccgtggaaccctcttgtaaatgacacgacagcctggcgcttcgtatattttctggcgattttcacggcgttttccaccgcttccgcccccgaattgagaaaaatcgcttttttcgcatgatctcccggcgcaagggcgcaaagtttttcggccagctcaatataagacggatacatcatgacgttaaatcccgggtgaatcagatcctccgcctgtttcttcacggcctccaccactttcggatgagaatggccgacattcagcgttccgatcgctccggcaaaatcaatgaatcgtctgccgtccaaatcgtacaaaagcgccccttccccttttaccgccatgctgcggtttccgttgccgacccccttggaaacgaattggtcccgtttttgctgccactgggcagttgtcacttccgatgatgctgttcgactcatagattccatccccctatattgttttcttatcattctgacttctttttggtatgatgaaaagtaccaaaatcaatttatccatggtatcagaaaggagcagggtctggatgctgacgatttccattaatcattcggaaacggcggattatatctatcagcagatctatcagcacataaaagcggccgttttgaaacgcagcctgatgcctcatacaaaggtgccgtctaaacgggagcttgccgagacgctgaaggtcagcgtgaattcagtgaattcagcttatcagcagctgctttcggaaggttatttatatgcagtcgaaagaaaaggctttttcgtggaggaaattgatacggtttatcatgaagaaacgccttcgctctcattgcctgaagatttaaaagagcgggagccggataagagcggctggatttcgttttctcatatgagcgtggatacggcgcattttcccctgaaaagctggttccgctgtgagcataaagcagccgcccgttcatttcatacactcggggaactcgtccatccgcaaggcttatatgaagtccgtgaaaccatttcgcggcttatttccctgacaaggggcgttacatgccgcccggaacaaatcgtgctcggggcgggcacgcaaatgctgacgcagctgctgacggaactgctgccaaaagacgcgctgtacgccatggagaacccgggatatatgaggatgtaccggctgctgcaaaacctcgggaaaaaggttgcgacgatcagccttgatgaaaaaggcatgtccatggccgaaatcgaaaaacgccggccctgtgtattgatcaccacgccttcccatcaattcccctcaggcgtgatcatgcccgcttcccggcggattcagcttttaaactgggccgccgaacagaacggccgcttcatcattgaagatgattatgacagtgaatttaaatatgacgccgatacgataccggcgcttcaaagccttgaccggtttcaaaatgtcatctacatggggaccttttcaaaatcccttttcccaggtctgcgcatcagctatatggttctgccgcccgggcttttgcggacgttcaaagagagagcgtatgacctgcatacgtgcagcacgcttgcccagctcgcgctgaaagaatttatcgactcaggtgaatatcagaaacatattaaaaagatgaagcagcattataagaacatgcgggaacgcctcatttcggctttagaagaaatattcggagaaagaatcagtgtaaagggcgccaatgcggggcttcattttgtcactgagtttgactgcgcccgttcagaaaaagagattttggcacgggcggatgcagaacagctcgatctgtttgcgatgagccggttccgtctgaaagcaggaggcgattcaaataagccgcagctcattctggggttcgcccgcctgaaggagagcgatattcaagatggcgtcctcaggctttaccgggcggttttcgacgcataaaaaaacccccggaattcggggacttatttaccagcggtccggttctgtctgcaaaatcgcctccagcaggccgggaaacgccgcttgtaaatcatctttgcgcagggaataataacggtgcttcccgtctatgcgcacttgggcgatccccgcttcccgcagcactttgaagtgatgggacagcgttgatttggcgacccggacatcagcgcaggtaccgcacgttttttctgttgtttccgccaattgtttgaccagctctaagcggagcggatcactcagagcatgaagaacctttgtcagctgtaagcggtcggtttcaggatggtttggaatgttcatgagtcaaatgtaacacataaaagcggcgggtgacaatttaggcggtgagggtttttcctttaccattcactgcgaaacatgttacagttagttcgataatattcgaactataacaaataaacccaatcaggaggaataacaatgatcgtcttacaggcttacatgaaagtaaaagcggataaacgcgaggaatttttaggagaagcacaatcacttgttcagcattcacgcgcggaagaaggaaatgtgcaatacgatcttttcgaaaaagtcggtgaggaaaatacattcgttatgcttgagcaatggaaagatgaagaagcgatgaaattccacaacgcaactgaccatttccaaggattcgtggcaaaagcaaaagaagtgctgagtgcgccgcttgacgtcgtccgcacagaactgtcagagtaacgaaaggatgaatgacatgaacgaagtccttcaaatattaacagaccaccgttccattcgcagctacacagatgaacccgtatcggatgagcagctggaccttatcatccaagcaactcaggcagcgccgacttccattaacggccagcaatttaccgttattgcggtgaaagataaggagcggaagaaaaaaatatccgaattggccggcggccagccgtggattgaccaagcgcctgttttccttttattctgcgctgattttaaccgcgccaaaattgcgcttgaagaatataatgatacaccgcttgagatcacgaacggtttagagtccgttctagtcggagccgtagatgtcgggattgcgctgggtacggcaacggctgcggctgaatcaatgggactcggcactgtgccgatcggcgccgtgcgcggcaagcctgacgaaatcattgaattgctgaaacttccgaaatacgttttcccgatttccggtctcgtcatcggccatccggcagaccgctccgcgaaaaaaccgcgtctgccgcaagcagccgttctgcatcatgaaacgtatcaagaagaagatttaagaacccatatcgaggcctatgacaagcagatgtccgaatacatgaaaaaacgcaccgacggacaggaaacaagaaactggtcacaaggcatcacttcctactataagcaggtttattatcctcacattcgtgaaatgcttgaaaaacaaggatttaagacggataaataaacgtatcagcctgtcggaacactccggcaggttttttctatttctcaaacaaaagcgttgacactatgtaaaaatttttgttaatattttcatcatatactcattggttttctgtgaaccgatgggttttctattgtgacgaaagaaggaatctgggcttatgaatgataagaaaacggatattctgctggcggcaaggaagcttttttccgggaaaagcttttcgtcggtctcgatgcaggcgatcgcagaggagtgcaaagtctccaaagcatctttgtataagctgtttgaatcaaaggaagacctgctcctggagctgctcgattttaaccagaaacagatggtagcggccgcttcattattaaatgaagaaacgagcctctcccctgaggaacggtttgccaaaaaactgatggctgagcttgaaggcttcaggcgcaaccagcagttttttaatatgctgatgtacggaagcccctcttccattaatgagcgggtaaaacggcatattcacagggcccgctccacctttatctgctggcatcgcgattcactgattcagacgtacggcgaagacattattccttatgtatgggagctggtgatcgtcctgcaggggctcctgagagaatgcatcacgctgattaagctggaaaaagaaccgctcgccctggagccgctcacggactttatcatccgccatctcaatctcatcgtcgaaaacaggaaaaccgaaacggctttgcctcaggagatgattgacctttataccgcctccgcttcctcatttgagccaaaagacaaaaccgtattgctggctgaaagcctgaaggaactgaaagaagccgtctcagcccttccggaggaaaaatatgatgccgcaggactcgcttccgcggcggttatgctggagaaagaatcagcggacaaacagccgcgggattttcttataaaagcgctcatcggttatttggagcaggccggaccgctgcaccagccgcttgcagccgttaaaacattgctcaaactataaagaaagaaggaatcagcttgaataagagtattaaaactgcaccatacaaccgctctgtcattgtcgggattcttttggcgggagcgttcgtcgccattttgaaccagacactgcttatcacggcgctgccgcacattatgaatgacttcaatatagatgccaacaaagcgcaatggctgacaacgtcgtttatgctgacaaacgggattttgattccgattaccgcatttttaatagagaaatttacgagccgcaccctcctgatttccgctatgagtattttcacggtgggcaccattgtcggcgcattcgccccgaactttccggtgctcttaacggcccggattattcaggcggccggcgccggaattatgctgccgctcatgcagacggtatttctcacgattttcccgatggaaaagcgcggccgcgccatgggtatggtcggcttggttatttcgttcgcgccggcgatcggcccgacgctttccggatgggcggtcgaagcattctcttggcggtctttgttttatatcatcttcccgatcgcagtcatcgatttgcttttagcgattattctgatgaaaaacgtcacgacattacgagaaacacagattgatattttatccgtgatcttatcgaccctcggattcggcgggctgctttacggcttctcaagcgccggttcctcaggatggaccagtactgaagtgctgacttcgctgcttgtcggagcggccgcgctgattttctttatcgcaagacagatgaagctcaaaaaaccgatgctggaattccgtgtgttttctttcgggattttcagcctgaccaccctgctcggaacgcttgttttcgcgctgctgatcggaacggaaaccattctcccgctttacacgcaaaaagtccggggcgtctccgcgtttgataccggattaatgcttttgccgggcgcgattgtgatggggatgatgtctccgtttatcggccgggtgtttgacagaatcggcggaaaaggccttgcgatgaccggattcttcatcatcctgctcacgtccctgccgtttatgaatctgacggactcgacgtctctcatttggattgtcgtcgtttataccgcacggcttttgggaacagccatgattatgatgccggtgacgacagcgggaatcaacgccctgccgcgccacttaattccgcacggcacagccatgaacaataccgtccgccaagtcggcggttctatcggtacggcgctgctggtttccgtgatgagcagccaggccgcgcacgccaatgcgtcaactccggcaaacgccgccctgcacggcatgaatgcggcctttgtcgtagccgcctgcatcgcgctggccggcttcctcctatcttttacattgaagaaaaaaccgcgtcagcccgagcagcagcaggccgttacgcggtaaaccaaaaagaacccgatcacgtatgtgaccgggttctttttttacttctcgattccgtcttttacttctttcaccatttgcgccatggattccaggccgcctcctgataaataccatgtagctgaatcaaggtagacaacatggttgtttttcacggctttcaccgattttacataatcattttcaaccacttgttttgttgaagattttgtgccgatcgctgttccgcggtcaacgacaaacatgtaatcagggtttgttttggcgatatattcataggaaatgctttgtccgtgcagtgaggcttcgatgtttttgtcagccggtttgacgccgaacacatcatgaatgaagccgtatcttgatttagacccgaacgcgctgattttgccgtcgttcgccatcaccactaatccgtttttatccgtgctgcttgtctttttcttcagatcggcaatggatttgtcaattttcgcaagcttatctttcacttcattttctttgttaaagattttgccgatcacttcggtgttttgcttgaatctgtcaacgtagtttgtatagtcatcatcaagataaatcgtcggcgcgatttttgagaactctttataagaatcagattgtctgtgggcgataatgattaaatccggatcaatatccgcgactttttcaaaatccggttcttttaaaccgccggtattggcgtatttatcactattatatgaagataagtattttggaaggttttgtttcggaagtcccgccacgtgatcctgtaaaccgagttcatccatcgtatccagcattccgaagttgaatacgacgacttttttcggattcttcggcactttgactccttctttgttcagatcatctttgattgtgattgtttcttttgatttgcctgatgttttgtccccgtttccgcatgcagaaacaacaaaaatcgtaactagcgcaatgaatagcaatgcgaattttttcatgactttcacctcatctggtttttaagaaaagtacacaccgatccgctgactgtcaatctcttgaatcgggatggtcatatcataaatatcttcaagcacggaggtttcaatgatctcttccgccggcccttctttgacgatccgtccgtttttcagtgcgacgatatggtctgaatatacggatgcgaagttgatatcgtgaatcactacgacgaccgtttttccgaagtcttccacaagccgcttcaacagcttcatcatttcaacggaatgcttcatatctaaattgttcagcggctcatcgagaaaaatatagtccgtatcctgagcgatgatcatcgcgataaacgccctctgacactggcctccgctgagctgatcgaggtatttatcctttaagtcatccagcttcatataactgagggcctggttgatatgcacccaatcttcatccgtcagtttcccttgggaatacggaaatctgccgaagctgaccaggtctttaatcgtcagtctgatattgatttggttcgtctgcttcaggatgctgatttttttcgccagatcgttgcttttacaggccccgatctcttgcccgtcgaccgtgatttctccggaatccgtcttaatcagccggctcatgatagacagcagcgtgctttttcccgcgccgttcggaccgataaacgaggtgagcctgcccttttgaatggatagagacgttttctcaaggacggttttccctccgtattgtttgcttacatttttgacctctaccatgatttattctcctttaacagcagatagataaaataaatcccgccggcaaaattaatgatgacgctcagcgtcgtggaaaacgtgaacactttctccacgacgaactggcccccgacgagcgcgacgatgctgatcaggacggaacccgcgattaaatacgtgtgcctgtaggtttttaaaaactctctcgccagattgacgacaagcagtcctaaaaacataatcggcccgacaagagccgtagagacagacacaagaatggcgacgacgatgagcatctgtttcacaagcttatcgtaatcaatcccaaggttgacggcgtgctccctgccgagcgacagcacgtcaaaaaaccgcgtgaaccgccagacataaatgcctgtcagaagaaagacagcaccggcaaatcctaaaagatcggtgttgatattgttaaagctggcaaacattttgtcctgaacaacctggaactcattcggatcaatcagcatctgcataaaggatgacagactgttgaacagcgtgccgaacacgacaccgacaagcagaaggaaaaacacgttccgcccctcgcctttaaacatgagctgatacaaaacgagtgacaagagcaccatcagcccgacggagatgacgaaattaagatttttgttcatcatgacgatattcattgaaccgaacaggaacacgatgacggtctgaatgagcatatacagggaatcgaggcctaaaatgcccggtgtcagtatgcggttatttgtaatcgtctggaagatgaccgttgaaaacgcgatcgctccccctgtgagcatcatggcaagcactttgaagcatcgtctcggcagggagtattcccaattgcccagtccgtagaacagaaagaatccgatacatattatggcgagcgccgccagcagcgtaatttttttattatgactcatatgcttttctccttaacagcatatacaggaagatgccgctgccgataacaccgaccatcaggccgatggaaatttcgtacgggaagatgatcacccttcccaaaatgtcgcaaaacagcacaaaaacagcgcccaagagagcggtgtgaggcaggctgctcctcaggttgtcccctttgtaaatcgacaccatattgggaatgatcaaaccgagaaacggcagcatcccgacggtcaggatcaccagtgaagcgatgagcgacacgataatcagaccgatattgacgacgcgtttgtatttcaggccgagattgacggaaaagctctctcccattcccgccaccgtaaatttatccgcatacacataagcgatgatcaccagcgggatactcagatataaaagctcataccggcctttaacgaccagtgagaaatctccctgcagccaagatgacaggttttggatcaggtcgtatttatatgcgataaacgtggcgattgagctgacgatgttcccaagcattaaaccgacgagaggaataaaaatcgcatcattgaacttgattctctcgaggattttcatgaaaaggaaatttcccgccaacgcgaaaataaaagcgatagacattttcacaagcgggctcgctgacgtaaaaagcattaatgaaatcaaaattccgagccttgcccagtccatcgttcccgcagtcgtcggcgatacaaatttattccggctgatctgctgcatgattaatccgcagatgctcaggctcatgccggcgatgataatgctcaccaaacgcggcagccggctgtcaaacaatgtacctgcctgttctttatttaaatgaaaaatatccagcggcgacaaatcttctacaccgataaatatagaagtacacgccaaaaccgccagtagcaaaagtaagtaacgtagcttcatgctgcctccctgcacccatcacaaacggtatgactgattgccaaacaactcccatatatccccactcgtaatgattatcattatcaacgacaactataatcttatcatctttccaagcgcagtcaatacagttttgctttcaaaaacggtcatccgcgggccgtacactaaattgtcttacaatcagtctatcaagaatttgcaggattttctataaccttcatttggctgcttatcattttttgcacatgatgacacgcttgcgggaaacaaatctgacaaacagcggcaaaattcctccacgaaaatacaaatgttctccccacatagaaaaaatccttgatttacatgtttgaaagagagataataaaaattaaatttgtgagaaaatttaaatattaggggatgtaaatcatgaaagttgtaaaattcggaggcagctctcttgcgtcaggagcccagcttgagaaagtgtttcaaatcgtgacggctgatccctcgcggaaagccgtcgtcgtatcggcgccgggaaaacgcttctcggacgatacaaaggtgacggatctgttaatccgctgtgcggagcattatttgcaaaatggtgcagcgcccgagcttgccgaaccggtcattgaacggtacgccgccatcgcgcgtgagctgaacctggatttctctattatagaaagaatccgcagtgacctattcgctctcttaaacagcagcaaagccaatcccgatcagtatatggatgcggtgaaagcgagcggcgaggacaacaacgcgaagctgatcgcggcctacttccgccggcagggcgtgaaagccgaatacgtaagcccgaaagaagcggggctgtttgtgacgaatgaacccggaagcgctcaggtgctccctgagtcttatgatcatttgtaccgtctgagaaaccgtgaaggcttgatcatttttccgggatttttcggttacacgaaggagcatgagattgtgacgttttcccggagcggttctgatattaccggctccattctcgccagcggcttaaaagccgacctgtacgaaaactttactgatgtggacgccgtctattccgtcaacccgtcaatcgtgcggcatccgaaagagattaacgaactgacgtatcgggaaatgcgtgagctctcctatgccgggttttccgtttttcatgatgaagcgctgattcccgcttttcgggccggcatccccgttcagattaagaatacgaataatccggaggcgaaaggaacgcgcgtcgtcagcagccgtgacaatacgaacgggccagtcatcggcatcgcaagcgacacgggcttttgcagcatttacataagcaaatatttaatgaaccgggaaatcggtttcggccgcaaagcccttcacattttggaggaagaaggattgacgtatgaacatgttccatccggcattgacgacatcacgatcatccttcggcacgatcagatggactcagaactggaacacaggctcgtcacccgtctgaagcaggaacttcaagcagatgaagtcacagtcaggcacaatctggcgctgattatggtcgtcggggaagcgatgcgccataatgtcggcacaaccgccagggcatccaaagcactgtccgaagccggcgtcaacatcgagatgatcaatcaggggtcatcggaagtcagcatgatgttcggggtgaaagaagaacaggaaaaacaagcggtgcgggcgctgtatgacgagtttttcgccggagtcttactcccataggacaccgcctcttttttctcttgtccactaatatcccttacaaagcagcttcttttacatattgtatggtatagacaatatggaggtgaagctcatgtcaggatattctggaatcagctctttcgctttgatcgttgttttatttatcctgttggttattgtaggtactgcctatgttggcggtttctaagcatcactccgtctatatgaggacgctgcgggttttgacctgcggcgttttcttttgttttccgccgctgtccaagtccggccgcgcaaaaaaaagactgccgggaacattcccgggcagtcttttcctttgttcaggttattttcttctcacgtcattcctctttcagctacatggaattcagcctgatctgtctggcctgcacctgtcactgtaaaaatcgcggcggctgctaaacaaataacaaaccatttagatttcaatttcatacaaaccctcactcctttgtatttgtttccttgcctcttcgactttcagaaaatagtcagaagaaatcttaaagcaattttgttcatagtaatatttagctgcttctagtgctaaatcctctatatcggcgtataaatttttatcttccaggtaacggaaacacgcgctgattgtttcctcatccggtttcgcctgatacagagcctgcagccattcgaattttaccgtgtaaacgggatcgtctgtttctttagcatattcatatccccgcttgtgatattccgacgctttttctttttttccgagtttaaagtaaatgagtgtgattaggaaatatgcttgaggaagagaattgacgattctttgtgattcaaatgtatcaaccgcccgttcaaagtacggaatcgcttcgccgatgcggtcctgattgtagtagcacagtccgaggttatacagcgccctcccgacaagctgcgctttttgttctttttcggccatttgcaaagcgtgctgaaaatgtttggccgcctgttcaaagcgcctttcatccattaaattgacgccgaatacaaaatggcattgaatgatcctgacgttatatgtgtcctgctctacgtaaatttcataagcgttttttatatgtatcaaagaaaaatacgtttgtttcatatgataataagcttcggccactttaaaataaaactccgcccgttccacgtggtccgatacgaaggccagttttttctcagcttgtttataatacgtaatcgctgagataaattctcttttatcaaattcaaacatgcctttgaaaaagttgacgtaataatcgagaagccctttgaggccggcctggctgttatcaatgttatcaagaatttccgacagggtcggctggtcttctatcttcagtttttccagcggctccaagtagtccagcatcagctgatggcgaaattccatgagggaataataaagcactaagtttgaatcaggctccatacggtcaagctcttgtttgatctcggccttcaagatctccgcatccggcacgctgaatgttctgatgtatcgataccactcgttaattttctgcccgactgctgaagaaggaattaacccgctcttcattccttcaccctccccatccaagacctgtttaccagttattttatcacgtttccgtgtctttccatcccgaaaaacacgcaaactttgtttcggcagagcgcaattttccgagtgaagataaaacagccggtagccagacgggactgccggtttcaagatgattcatgtatcgtattcagcggaaggcggattgtaaacgtcgtgccttttcctttttcgctggcaatatctatcgtgcccttgtgcatttcaacgagctgcctgacgatggacaggccgagtccgtattcgccgtatgccgtattcgtccgggacacgtccgccttataaaaccgctcccatatatgctcaatttcctctttggagatgccgattccggtgtcttcgatctcaatcaccgtttctttatagccttcatacccgcgcagcgtgatgtctccgttttgcgtaaattgaatgctgtttttcgtgatgttgacgagaatctggatcagcctgtcataatcggcgaacactttgacgccgtcctccgcctgaatccgcagctgattttgtttttcctccgcctgctgattgagatgctctttaataatttcaaacacctcgatgagcggcagactgagcttgtccagtttgatttgctgggatctgattttttcataatccagattttctttcacgagcctgagcatccgcttcgtttcttcactgatcagcgagaagcatttctctttatctttttccgggatggtgttgctgttaagcccctccacaagtccgttaatggtcgtcaaaggcgttctcagctcatgggagacatcggcgataaattggcgcctccgtttttccaggcggtcaatctgctctctcgattgcttcagatttttggccatgatgttgaaatcggacgccagcatgccgatttcatcgccgccgctgttcttgagcgaaatatcgtaatccccggatgccacttttccggtcgcatcccgcaatgtctgaatccgcttaacgtgaaatttagataaaagccagctcagcagaatcgtgatgataagggtgctgataatcgcgtaaatcatatagcggttgacctggctgatcatctgctcgacccctctgacgggagacacgagcagcaccgcgcctttaaattgatcgttgatcaaaagcggttttgcgacaagcgatacttccaagccctccgtattaaaacggttcatctccgctctgatctgaacggttttcccttgcttcagcatgtgccactctttacttttgagcttctcgcgcggcggcatatcgtcaggaaaaaagtaaggccgctgatgttcatcaaaaataataaacctggtctcgcgcgtttttaacatgtcctgatacggatacaggcggcgcagatcaagatcgcgtccgttcagctcacttgtgatctgctgggcgtaagaagacagctcatccactttattttgatacgcaaaatctttcacaaagtgcgaaaacagggaaatgataatgaaaaaggccaaaatcaaaatgctgacatggcttaacagcagctgatataagtatttaatcctcatcaaatttgtatcctacccccacaccgtgtataaaaacggtttttcctcactggacagttttttgcgcagccgtttaatatgaacatcaaccgtacgttcatcgccgtaaaattgatagccccacacctgctcaagcagctgctctctcgaaaagacctggcgcggattttgtgcgagataaaagagcagatcgaattccttcggcgtcagattctcgacaggctttccatgcagaaacacttcccgcgtcttcttattgattgaaaaacacgccgtttcgatcaagtcgccgctttttacggcctgccccgtcgcccggtatcttctgatcaccgctttaatccgcgctactagcgtcagcgggctgaacggcttggtgacatagtcgtcggctcccatttcaaacccgatcacctgatcagactccgtgtcctttgcggtcagcataataatcggcacactgctcgtctctcttattttccggcagatcgtcactccgtccatagatggaagcataatatccagaatgaccaaatcccagtcctcttccgtgaaccgctgatagccttccactccgtcatggacaaattcggcttcaaatccttctttaaaaaagaacatttccgtcatggtgcatacgcttatattgtcttctatcattaatatcttcattgggtcctccgtttatcttgacgcttttacttataatagcaccattttacccggatattttcgcgtttcacaattgttagtttttatttcatcacccggaaatagtttgttcatatttttttcatacatttctcctactatatacatatcggataaccggttctaaagaaggctggttttacaagatctgacacccacacggaggaacagacatgaactttataaaaagagccttttggagcatgaaggcaaaaaagggaaaaacgtttttgcagctggttgtgttttcagtgatttgcatttttgtcctgtccggtcttacgatccagtcagcggcaaagaaatcaagcgaactggcaaggcagcagctcggcgggagcgtcacactccaggctgaccgccaaaagcaaatggcgcagcagcaaaaagacggtgaaaagaggacgtttgaatcaacgccgatttccgtctcggatgccaagaaacttacatctttacagcacgttaaaaattacaacttcctcacgacagcgtcagcaaacgcagaaagctttgacgcgataaaaagctcagacgaatcagccgataacagttccggcggaagccgttttcaaggcggcggaagacagatgatttcagcggatatttcggtcgaaggcgtgctctctacggcgctgcttgatgatttcacaggcgggagctcaaaaatcactgatggccgcgccatcacaaaaacagatgcggacgcaaaagtcgcagtgatcaatgaaacgctggcagatcaaaacaagctgaaggtcggcggctccattacagtttcctcagcagcggatgattctgtgagtacaaagcttaaaattgtgggaatttataaaacaacatcatcaggagacgatcaggcagagcatttttcattcttaaaccctgacaataaaatctatacgccttacaccgcagctgcggcgttaaaagggtctgataacaaaaacagaatcagctcagccgtttattatatggatgatgcaaaatatattgactcattcgttgcggctgcgaaaaaaacatctatagatgataaaacctacacgctgacgacaaatgatcaggtgtatcagcaaatggccggcccgattgaaaatgtcgcgtcattttctaaaaacgtggtgtaccttgtatccatcgcgggcgcggtcattctcggattgatcgtgatgatgtcgatcagggaacgcaagtatgaaatgggtgtcttgatggcgatcggcgaaaagcgctggaagctcatcggacaattcttaacggaaattctgattgtcgcggttatcgccatcgggatcgcatccgtcacgggcagccttgtggcgaatcagctcggaaatcagcttctttcccagcaggtcagctcagccgatgattcccagcagcaaacaagcggctggggcggaggagaaatgccgcggggagacggcatgttcggtcagcattcatccggtgcagatgtcatcagtacaatgcaggtaaacgtttcgctgaatgaccttctgattctcggcgggatcggcgtcgcaattgccgtcatcgccacattactgccgtctgtatcagtcatgcggcttcaccctaaaacgatcctgaccaagcaggaataagaggaggcagcataatgagcctattaacctttcaacagatcggctactggtaccaagataaatcacagccgctgtttcaggatataacgatcagctttgaaaaagggaagttttatacaattgccggcgcctccggaacgggaaaaaccacgtttctgtctctggcgggcggccttgacacacctaaagagggaagcatcctttataacggagaagacatcttcaaaatcggattaaccaaattcagaaatcaatatgtctctatcgtctttcaatctcatcatctgatcccgtatatgacggcgctccagaacgtcacaaccgcgatggagattaccggatctaaggagaacaacaaagatgcgtccgcgctcagcatgctggataaagtcggcatcaccgaacagcaggcccgtcagcgggtgctgacattaagcggcggacagcagcagcgcgtttcaattgcgcgggctttctgctgtgacacggatctgatttgcgcggatgagccgacgggaaacctcgacgaggatacgtcaaaggaaatcgtccggctctttcaggatctggcgcataaagacggcaaatgcgtcatcatggttacgcacgacgaacaaattgccaaagtgtctgatatcaacatccgcttatcaagaggaagtttcacggtcaaagaaaacggcacggccgtttcctgataccgcgcccctgccagcgcagacaggggcgcaccctatatccccctattcaatagaagtgaacgtaaaaagagccagggctgcatcccctcgctctttttatttatatcagctgtaaataacggtcaatatttgattgtccggctgctttgatcaattcttccgcctttttctcttctcccggcaaagcgagccggagcttgtcttcaatgtctttttcagaaagaccgtttcccggcgctcccctcggacagtcgatacgtgcttcatagacatgaccgccggaaaccgtgacccgtacaattgtaaaacggcccttcggaacggcgttgtcagccggctgaatttggtcatcgcagctgcggtgaatccgctcaaatcctttttgaagggattgcggaatcggctcggatgtgaaatgttcaactgaaaaatccttaccgtgcaaagctaaggtgatcacatattctacgctgaaccgacccgcttcgcctgttttcggacgccgttctgtcaatgcggcgtccccgcccggcggataaatcacgtcaatccgttccgtttggccgaaagtgagaccatgttcggccttcagcttgagaatggcgtccgccgcatgatgggccgccgagcaaaacggataaaccttaaaccaaagtcccggactcacgatccgccaagggtttccccacccgtttacaagcagggtttctgcccgttcaagatcgccgtacagtccgaaaaaacctttctccccgtcgagcgcatgagctgagccgccgaaaccggcctttgcaagctttacggcgaacaccccggcttgagcggccaggccggcgtggagcggcttcatttctgtcccgaattgcactctcatgcctccggaacgggcagccgcaaacccgattgctttctgtaattgggtttgattcagattctctgcgaatccgacggcgcatgcggccgaaatggcacctaacgttcctgtattgtgccagcctttctcgtaatgatcccttccagctgactcgccgagccgcgccatcacttcgattcccgtcacataagcaccgagaaaacggctcttgtctatccggccggctgatgcggctgcaatcaaagccgggaggatgaccgcgctcggatgtcctcttacatcagaatgaacatcgtcaaaatcaagcgcatgtgcgatgaagccgttaatgagcgcggattgggacggcgtggttttttgatttctgccgataagcggcgctatcggcatcccgccttcttcttcggccagttttaccagcttttcaactcctgtatcccgtctccccgcaaaagcagccgctgtaaaatcaagcagtcctttgcgcgcttctttcatcgcttcggcggatgtttccggcacagacgacatgacggcctgagcaagtccggccgtcagattttccgtattcattccgtctgctccaatacattgacggcaagccgggcgaaaaactcagccgctttcggaagcgctttttcgtcgagtgtaaaggctggatggtgccattcttctgttccgtttgttcccatccagacgaagaagccggggattttttcttgatataatgcgaagtcttcgccgccgggcgactgttctgcccgaacggtttgaagtccgaggctttcagccgtttgttccgccgcctgtatgaatcgggcatcgttcatcactgacggcaggtaaggaaaccagcggaagtcagcctctgccccgaatccggccgcgattccttcggcaacccgcttcatatgtttcggaacagcgtcccgcgcttctttttgaaacgtccggacggttccttccatttcaacatggtccggaatgacattccaagaactgcccccctgaactcttgtgatgctgacgacggcattgtgaagcgagctgatgtttctgctgacaatcgattgcaggccgccgatgatctgccctgtcgcctgaatcgggtcaatgctgttgtcggggattccggcgtggccgccttttcctttcacggtgatttcaaagcggtcgacactcgccataagcgggccttctttcagaccgaccgtgccgacggggaggtcaggtttgttatgcatgccgaatatcgccgatacaccgtcaagcgcgccggcttcaatgacctgtcttgctccggcggcgatttcttccgcgggctgaaaaataaaccgcaccgttcctttcagctcatgctttctctcatttaataagaaagccgtgccgaggatagatgccgtatggaaatcatggccgcatgcgtgcatcacgccgctgttgcgcgaagcaaacggaaggtttgttttctcttcgatcggcagtgcgtcgatgtccgctctgacggcgatgacggggccgcttttatctcctttgatttcagcgatcactccggtttgaagtttcggcacatcaagaaccgtgattccttcttcctccagccagcggcggattttattcgtcgtttcgaattcctcgcctgacagctcagggtgttcatgaaggtcgcggcggatattgattaaacgtttgtttaatgattcatacgtttcatttgccatttcttcttcttcccttcttagacaagttcggcaggctctcccacttgcttaatgaattttttcgtccgttcgttctgcggattgtcaaacagctcctccggtgttccctgttcgatgatgcgtccgtccgccataaaaataactttgtcggctacttcacgcgcaaaagccatctcatgcgtgacgatgatcatggttgtctgtttttcggcaattgatttgatgacttggagcacccctgctacaagctcagggtcaagggctgaagtcggttcatccagtaaaatcgcgtgaggatcaacggccaaggctctcgcaatcccgatccgctgctgctgcccgcctgacatcgtaatcgggtagctgtccgctttgtgttctaaaccgacttgccgcagcaggtccataccgatctgttccgcttcttttttcggtttcttttgcgcggtgatcagcgcctctgtcacattttgcagggcggttttgtttttgaacaggttgtaattctgaaacaccatcgccgtctgctggcgaagcttgtgtacgtctttgcgcgaataggacgctgcattcagctttgcatcgccgatttcaatgatgccgtcatccgggcgctccagcagattcagacagcggaggagcgttgattttcccgagcctgacgggccgatgatggccgtgacttcgccgcttttgatctcaagatcgatcccgtcaagtacggtaagatctttaaatgcttttcgaatatgtctgacttgtatcatcctgagcctcctcctatgtgcgataaggcttgctgatcgcccgttcgagcagatcctgcagcacactgtaaataatcgtaagaatccagtacatgaccgcgacggctaaatacgtctcaaaatatttgaggttgcccgatgcgtacatttttccttgggcgaacatctccatcacacctaatgtaaaagcgagcgatgtttcttttaacaggccgataaacgtatttcccgtcgcgggaagcgcgtttctgacggcttgcgggaaaatgatccgtctgtacgcctgggattttgtcattccgacagacagacaggcttcaagctgcccctcatcgactgagttgagcgcagcgcggaagatttcagccaggtaggcggcatttttcaggcttaacccgataatcgccgcagttaacgccgtcatcttgctcatcccgggaaagagctgaggcaggccgtaataaattaagaaaagctgcacgagcgtcggcacgccccggaaaaatgaaatatacacctttgacagctggtgaagcacaggaatacgatttttgtgataagcgctaatataaggccgccgatcacggcaaataccatggccgcgacggccattagtaatgtgatcggcaaggcttcgattaacgcgggaaaagctgaaaacataaatccccaatcaatgctgttcattctcgattttcaccgccgtttcttattgctttgcttcctttgtgatatcttcgttaaagtacttttcagacagctttttcagcgtgccgtctttccgcaggtcttcaatggctttgtttacttttttgcggattttatcgtgagccgcatctttcgcaaacgggaaagcgactttttcatagacaatcgggtctcctgctaatttcagaggcagaccggtctttttgatctgggcgatcaggacgctgcggctgtttacataggcgtcaacccgtccgtaagccacgtctttcagcgtaccttcttgtgtttcatatgtttttatgttgatttttttatccgggtccttgctctcaaggtttttcgcgtggtttgagcccagaacggccgccactgtttttcctttcagatcattgactgatttgatgtctttgttatcgtttttgacgacgacttgagtgcccgcatacgaatacggttctgtgaagttatacgttttcttgcgttcgtccgtgacagcgacctggtttgaaatggtgtcgagtttgccggtctggagctcgcccatcagtccgctgaactcaagcagcttccagtccagtttcatgttgatttttttcgctacggcttccattacatccacgtcaaagcctgtcagcttgccgttttctttatatgcgaacggatagctttgtcccgtagcgccgacatgcagcacgttatcgccgccttcgctttcttttccgtttccgcatgctgttaagaccgccaaaagcgcggcagacagcagcaaagcccatgttttcttcttcattgaaatcccgccttttcctattaaaatgttaatcctgcaattgtttttttaaatagatggtgatgtggccttttcctaaatccttttcgcctgcgcggacgtagcctttccgctcgtacatgccgatcagccacggatgcttgtccgctgtgcccagtgacacgaaaggcgcttttaatgtatcgcggagcactgtgttctccagccactccagcatgtctgagcccgtccctttttttccggtttcaggatcgacggcgaaccaccaaatatgagggacaccgtacggcccgggattcggcccccacggcatccgcagagaaatcgtcgccagaatccgtccgtcttcctccaaaacgtaacaggcgtttttttgtatgttattcaaaacgagctccttatccgccgttgctgcggcaaagttgatgccgagcttgcggatcggttcatacgcccgcagtgtcagtgaaagcagctcatcagcgtctgcctccgttgcgagccggtattgtcttgacatgatgagccctcctttagtcggcatatcggtttgccggtttttccagtccgaaatgttctctgagtgtggttccttcatactcttttctgaacacgccccgttcttgcaaaatcggaatcactttgtctacaaaaagagtgagaccttcaggcaaaagcggcggcatgatgttgaagccgtcacaagcttgttttccgacccattcttccatcttatcggcaagctgttcaggcgttccgacaaagatatgatggcctcttgaacccgccacatatttgtacagctcgcggatggtcatgttatcgcgtttggccatctcctgaacgagcttgaaccggcttttaacggcattcgacgcatccgcatccaattcaggcagcgggccgtcaagcgggcaggcggaaaggtcgacgccgcccagatagttttgcagaatgttcaggccgacagacggaatgatgagatcttggagctcttcatattttgcctgcgcttcttcctcggtatcggcgataacgggaaatatccccggcatgatcgcgattttttcaggatcacggccgaaagaagccgcttgttctttaatagattgatagaattcctgcgcggactccaaatgattttgcgcggtgaaaatgacctccgccgttttggcggccagcgcttttccgtctcctgatgatccggcctgaataatgaccgggcgcccttgaggtgtgcgggcgacatttaacggccctctcacggagaaatatgttcctttatggttcaattcatgcattttttctttatcgaaaaatgctcctgactctttgtcacggataaaggcgtcttcctcccacgaatcccataatcctttgacgacttcaacgaattcttccgcgcgctgatatctgagatggtgctcaagatgcttttcgccgctgaaattaagcgcggtcgattcaatcgaagatgtgacgacattccagcccgctcggccgttggaaagatgatcaagcgatgcaaattgtctcgcgatatggaacggttcgctgtatgtggtagacgcggtcgccgtcagaccgatgcgggatgtgacctgagcgagcgccgacagcagcgtaaacggctcaaagcgcgtcagcacattcggatgtgatttgccgtctattgataaactgtccgccaaaaacagcatgtccaatttcccccgctcagccgttttcgccagttctttgaaataatccaaattcatgctcgcgtccgccggtgcctgaggatgtctccaagaagcgacatgatggccggtgcccgcgagaaacacaccgagtttgatttcttttttctttgtcatgatggatctccttctattctgaaatacggttcggaaaatattaacaccactaaacctatatttcctagtaattttataagaataaatcaaaatgtacaattgtcacgcaagtttgtcaatgcattaagacaaaaatcatgattttaaaaataacccggcgcaccgtccgggttatttcttcgaaactgtatagacggtccctttgacctttttcttaataacggcaatgataagcagcaaaacgggaaacagcacttgaaacggaagatgaatatagatcggcacaatgtttaagccttcattcatgtgttccgaaaaattgcttgcgatgctgatggagagaatcagcacccccaatccgaccggaaaggccagctgagacggatttttttctttaaacagcgtggacacacccacgacaaccgcatatgtaaaaaggctgactttgaaaaaaccgccgatgacgagcacgagcatgaaaaagacatccagccggtctaaaaactcttctactttaatcgtctgtatggtgctcagcagcggaaattgagagcggagcattaagttgacgtccagcacacaaatattaatcgccactgacatcgccaaaaacagcccgctgatgataatcgccagaaatccggttttcttcacctttttccgatcttttaaataagggaaaatcatgacaaacacgattaattcaccgaacgggatgaacatcgtctgtttaaacacggaataaatgaccgttcctgcaccctccgctaaaacgggctggagaaatctgaggtttatcgtgcctgagctgataatgaggatcagcccgacggctgtcagaaaatacataatgccaaacagcagctcgccggctctcgctatcacttcaataccctttctgaccgcaaatatcgcggcgatcatcagcatggcattcacaattaaaagcggcgtgtcctggtaggcgaaggtgacaagcatttcgccaaaatcccgcaatacgcgggccgcgatataagaaaaatagagaatataaagaagcgagaccgcccagctcagatgtctgccgatcagttcgttcatgtaatctctcggagaagactcaggaaaaaattgatacagcgcctgataaacgtagaaaagtccgagaccgataacgcacccgagaagcacggacagccatgcatcccgcccggccatcgtgcctggcgggatcaataacgaactgcccaattcaaacaaaatgatcataataaacagctgacgcgtgccgattttcgcattttccatacgcttcgctcctttctcctcaaatcaatcatgctcaagcttgtctgagagaggattattccgcaagcccgttcttctgataatgacttccgttttgacatctacggggagattggggaaatattcttcatcccacttccctttgaactttttccatttgtccggatgcttccgatagatcaggtctccgaagccgacgaagtcattcttacgggcttttatatcttcaattgatttggtgatatctttgtcaagctgcacgctgagcgccttttgcatcgtcatcagcacttgcggatcagacagatggaaagggtatctgacagcgtccaccagcccctcgacctgagcatgcacgtgaatatgcggttttccgttcggaaaagtggccgtcacctttgtattctggcgggtgacctgcagactgattgcgtgcttcacattcttccaatccgcattgatgaacgtatgcttgatcctattgagcagccatacagcccccacactgtcgtcatcctcaatccagtaatccagcctcccatcctttttgaacaccgccagtccgtccgctgacagcactgctttcggttcagtcgtctgcgtattttccatcgtaggaccggctttatcgtctccgtgcatttcataacccggaataaacggcgacccggccggagaagcgagatcaatcagaacgtcctgaaggctggttttaatgactctgccgtattgttcctgcgtgaagctgagcgtcttgttcactttattggaagggattttatcaatcggcgtcagcactttaataatgtcttcagccttgcaattatgcgcgatcaccgcggttgcggtcgtcctgaattcggtgtcgcggtcaagattgtccagaataaaactgagcccttcctctttcgccagcttttcactgaacaccacgagattcgtatgcgcaaaatagagccttctggacactttcatcgagccttttctcaaagcttccgtcatattgtctccggacaccgaatagacggaaaccggaggccggtctcccgctccgccgccctgcagaccgccggccacgtttcccggattgataatttgcaagtgaaggacgtattttcccgtttcggtccggtcaataccgatggcggagatcacagccaaatcagtcagctcccttttatcccagcatccggatacaaacataagggaaaccatcgtacaaaggataagtatccatttacgtcttttcattaccgtcgccctcttctacatctttattaaccatccctctggatgtctccggtttcggtctttgatgttccccttggcgcctgttgttttcctgcacgagcagttccggccttttttcatctgcccataacggagcgcggaggatggaatccttcagcccgcccggggtcaaaggagcgagcggggacatatacggaaaaccgaatgaacgcaggccgcacagatggacgaacatcatgataatgcccagaatcagcccgtaaaatcccatgaccgccgctgacagaataaagagaaaccggatcagccgcgcggatatcgccatgtcaaaagccggggtcgcaaagctggcaatcgccgtcagcgcgacgacgataaccatggccggggagacgatgccggcctgtacggcggcctggccgatgacaagcgctccgactatggaaacggcggagccgacaactctcggaagccggacacccgcctccctgagaatctcaaaagccacttccatcgtcagcgcttcaatcacggccgggaacggcaccgtctcccgctgagccgcgatgacaatcagcagctgcgtcggaatcatttcctggtgaaaggtcgtcgccgccacataaatccccggcgccaccagtgaaatgaagaaaatcaaaacccgcagcaccctgatgcttgtggcgatatcaaatcgtgaataataatcctcaacggattgaaaaaattgaataaataaggccggcgcgatgagaacgaacggcgttccgtccacgataatcgcaaatcgtccttccagcagattccccgccacgacgtccggccgctccgtatgatatacggtggggaacacagaaaacggcgcgtcttcaatgagctgttcaatgtagccggattccaggatgctgtcgatgtcaatgtgcttcagccgcttgcggacttccttaatcagctttttatcgcaaattccgttaatatacatcagcgcgacatccgtattcgtttcgtgtccgatctccattttttcaacccatacatcaggcgtttttacatacctgcggatcatggaaatattggtttgcagagattcagtgaatccctggcgcgggccgcggaaagagacctgagtgctcggctcttgaatggaccggtgctctcccccttccgtgctggcgatcagcgccttgtcagccccgtcgacaaaaatgagcgtgctgcccgccaccagcccggcataaaggcttttccatttttcttcctctttcaccccgccgatcgcaagcgttttatcgtatatcaggcagaccgcttgttccggctgaacggacgggatatcgattaaatcctccagaagggattggctgacaagctgttcgtctaccaaaccggcgatatacacgattgcggccggaagctcttcttttccgattttcagccggcggatgacgacatcggcactgttgccgaacctctcagacagcttcttcatattttgctttaagctgagggagatcggctcatcccgctctttgtccggctggctgtccgcttcttttctgccttcattgtcacggtcgttttgatcggcttttttttgtttcctctgcttaaaaaatggcggcatatcgcaaaaaacctttcctcgtttttttcatattcttcctgtacggcaaaagattatgcacggcggaaagtctgtataagttctgcgtaatcgaaaaggataaaaagggagagtgatgcgcatgaaaatattaggggtttcattctttttgctgactgcctgtctgatcatttcagtaacggtggatatgctgcaaggtttcagtttctatggagcggttcaaaacaacctgtccgcttttaaattgaccaccttctcagaatggctgatgctgtttttattcgccctctttttaatcagagaaatgatcgctttatataaatcaggtaaaaaagatgcctgacaggcgcaaggctgtattgtgtcaaaaaagaacacattcctccttctctcggagttcatgtgttctttttatttttccggcgcagattgttctcagatgacgatatttccgctttccgtatctgtcgcgtgcttcacaatgacgcctttgataatgcggttgccgatgattttagtacttgcggaggagctggtttggatggcggaagcagaagcggcggataggttgttgatggtattgcccgaaacgagggaattggaggctccgttcagatagatgccgatcgggctgcccgctgttcggttgatcgtgagcgtattgtctatgacttcatgcgtgcctgagttcagatacacggtaacgataagcggtgatgattcaaagcggttgctgatgacagaggttcccgaggatgttgaactgaatacgggatagtttttatagttcttaaagagattgcctttgatgacagccccggcgtcatttgtcacagatacggcataggactccgcggcgccctgatacgcattcggaaggagcgtatttccttcaataacggcatttccgcctgtgacccatatgccccggctgaacgatttcagcacattttgttttacaatgatactgccggccgacatgctgattccgtctgtcacctgattcagagtgttattcgtaaagacggcgttctccgaaagcgtcgcccgcatccccgtgcttcgtctcgtttcggaacgtccgttttcaatgacattgccgtcaacggtcacatcttctgcctgatagacggaaatgcccgtattttcaaattgattaattttgttgtgggtgacgaggacgctttttccccttacatctattccggtggaaaacccggtaatcagattgttggaaatgacggcactgctgctgtcctgtccttgtgacacaccttgtccggcgactgcggtccttgagccgccgtctgaccgaaagaagacattccccgtaatgacggtatgcgccccatacccgtagctgattgtgttatcggaatgatttccttcaattaacacattatatccgttaaaattggtgactgagcttgcggcgtttccggaaaagaagttgttgcggaccgtaatatgaagagcttcttcataatcaatatcgccttctccgtacgattcaatatcgattccgaatttcggagccgttccgttcccttgcccggcgtcttcaatcacgcattcttccaccgtaacggtattgcagccggtgattgaaatgttgttccgccttgactgcctgatctcacagcggcggatggtcacctgttctgaagtttcgtaatcactgtttgtttttaacccgagcgggctgacaattataccgtctcccgtaaaatctgaaatcttcacattttcgatcagcacattgctgctgccttcaatacagattccaaacccccattcatgggtcgaccgcaaagggacattggtatacgtgtgttcatcccgttccccgatgatccggccgccggtgatggtgacattttcacgcctgcctatatagaaagccgagtagccccaggagctgttcggcgccactttaatcgtgcattccggatctaaaacgatggtgagatggctcggcacgttaatcccggcgttccgaaacggctggcttttgtccccgccaagcgtgccgttgattttatacgttccgggcggaaaaaacaccgtatgacagccttcgctgacggctctggccaagcattggttgatggcgcccgtcacatcggtttttccgtctgccgccacaccgcaatccgtaatatccaatatacgattcggcaagtgataatctcctccttcctctcttattgtcatcttattccgccatatcccgctccgcctgtacatactttaaattttattaaaaaagtttataaagatagtttagtcagataatataacaaaataagtcattggaatcaggaaaattcgtctatattcaccgttttaatatcttttcattctggaattttttgaattcagtataaattatattgacacaagtattatataagaatatgatttttgtaatacacttttttaagaaagggttggctcaggtggcatctattgataaggaatctataacagaaactgtgccgcaacgaggctttttcggtcatccccgcggcttgttcacactgttttttaccgaattttgggagcgtttctcctactatggtatgagagccatattgctttactatttatacacggaagtcgctcatggcggtctcggctttgataaaacgaccgcagttgccatcatgtccatatacggatctctcgtatatatgtcgagcgtcatcggcggatggctggccgaccgggtattcggcacggcaaacaccgtattttacggcggaattttaattatgttcgggcacatcgctcttgccttccccggcagcacggcggcgttttttaccagcatggctctgatcattatcggaaccggcctgcttaaaccaaacgtatccagcgttgtcggagatttatatacgaaggaagacgagcgccgcgactcaggtttcagcatcttttacatggggatcaacctcggcggattgcttgcgccgctaattgtcggaacactcggacagaagtacaactaccacttaggcttcggatgcgccgcggccggtatgttcctcggactgattgttttcgctctaacgagaaagaaatacctcggcaaagcaggctccaatgtaccgaatccgatttctaaatcatcagtgatcggcacgggaatcggagtggtcatcgcagcagccgttattattgttctgattcaaaccggctggctgacgatccagcgtgtgattgacaccgtcagtatcctcggcattgtcattccggttatttactttatcgtgatgttcacaagcaaaaaagcgacgaaaacggaaaaatcacggcttgcggcttatgttccgctgtttattgcagcggcaatgttctgggcgattcaggagcagggcgcgacgattctagctttatatgcggatcagcgcacgagactttcctttgcgggcatgcatcttgagtcttcatggttccagtctctgaacccattattcatcgttattttcgcgccggtgttcgcgtggatctggatgaagctcggcaaacgccagccttcaacaccgattaaattcgcgatcggcattatccttgccggattatcatttttagtcatggtgcttccggttatgggcggaagcggcgagcttgtgagcccgctttggcttgtgctcagcttccttttggttgtgcttggtgagctttgcctttcaccggtcggtttatccgtcacaacgaaacttgcgcctgcagctttctcagcgcagacgatgagtatgtggtttttaacaaacgcctgcggtcaagccctgaacgcaaaagtagtcggtttgtttgataagatttctgaagcggcctacttcggctcaatcggtcttgtttcgatcattctcggtattattttaattcttctgtctcccgtcattaaacgggcgatgaaaggcgtacaataaaagagaagcctgcggaatcgtccgcaggctttttttgtgcgtctatcgttttaactcctcaagtgtttctctccatctcttcaggacatcttccggttcgtggagctggatggccggtcctgatgtcagatccgcgtatttcgcccgatcttccttgacggtgatcacgcggcagctgaaccgttcccgctcgtgtttcgcctctttcaacggcggaagcgccttacattccaatgtgacgtaatatgcggctcctccgtgccaggcgatgaaaagagcttgtcccgaatgcagcaggctttttacggtcgtcgtgtttttccataaggcgagccggagatttgttctgctcacggccgcgatttcaccggcgctgatcatggccgcgtgcggacggccttcttttgtcacggattggagcacaaatgcgtcgtgctgctttttttcaagttccgttccgtctaaaagcgcgtaaagcgcctccggcaagtgctccgtcagcattacgcttttctttccgggacagcgggaacatgtgtggccgtctctgtttctttcggatcgattttaaatgccgggttgaatgccgccggattcgtgatactttccggttcacaggatctccatgtgaaaaagcaggtttggcattggtatatttcccaagcgcctttgaccggcgattggctgacggtttctcctttttgcgattcacatcgcgggcatgttttcatagtaaactcatcctttcttattgattcattaagtccatcagtttttgttcccactctttcgttgtcagcggggaatcaagcggctgcgaataatggcctcttgtttccggcgcgacaggcgtcgtggcgtcaagaatcattttgtgtgtcatccctgccggatcagaccccgggtcaagcggaaggacggacagatcaggaatgatgactgcatcgtgtttcggatgcattttcgttgagagcgcccacatgacttgcggcaggttaaacggatcgacatcctcatccacgacaatgaccattttgcagtagccgagtccgtgcggcgtcgtcagggcgcgcatgccgacggccttggcaaatccgccgtagcgcgttttcgtggagataatggcgatcagcccgtgcgtatacatcgcattcacggcgacgatttcgttcggataggcttccttcagctgctggtaaagcggcacgcacgtattaatgccgatcatataatcgcactccgtccacggcatgcctaagtataaatgttcaaaaatcggattgtttctatgatatacccgtttgattttgatcaccggcatgctgcggccgcctgaataatggcccgtgaactcaccgaaaggtccttcgtattcccgttctcccgcaaggatctctccttccagaacgacttcagcaccccaagggatgtctaaatcagacaatttagatttaacgattctgtagggctccccttgaatcgcgccggccatttcatactcggattgatcgtataacagcggagttgatgcagccgtcgtaatcaccggctcacagccgagcgcgatcgtaacgggaagattcacgccgcgttcttcagcttggcgaagatgaatcgcaatatcatgctgaggcacgggctgaatgccgaggcggtctttcccctttacctgcattctgtaaatgccgacattctgcttgccgaaattgtccggatcttcaagatcgcgggaaatgacgcacgctttatccaaatagtagccgccgtcccctggttgattctgaatagcggaaggatgtcaaatagattgatatcttccgttatttcattttcatgaaacggcgcggtttcttcccgtttgaccggcaccggaaatgcatcgtaccgtttggcaaactcaaagaattgttctttaacaggcgtatctttcggcatgccgagcatcatcgcgtgattcggccacgagccgatgacattcagagccacctgcgcatcgtgatgtccgtaaatattgttaaacaaaagcgcaggggttttatccccgagattgctggctgcacgcgcggcggcgcccaggtccggctccggttttacctcttcgttgacggttaagagctgcccttctttttcaagagcggcgagaaattccctaaaatcctgataggccattatcagattcctcctttttgtttttcaattccgtaccaccgtttcgcttccggcagacggatgccgaactgatcgagcgtccggaacacaatatggtctatcaattcatccatgtcagccggcttgttatagaatgccggcatcggcggaagaatgacggaacccatttttgtaagcgctagcatattttctaaatggatttggctgagcggcgtttctcttgtcagcagcacaagttttttccgctccttcaggatgacgtcagccgcccttgtcagcagattgtcagccattccggtgcggatgcttgccagtgatttcatgctgcacggagcgatgatcatcccgtccgtttcaaacgaaccgcttgaaatcgccgctgcctggtctttgtgagaatacgtataggatgcgagtttctcgacatcttttaacgtataatcggtttcatgtgtaatggtgacatttgcccaaggagacacgacaagatgggtttcgatctccgcggcttttaaatattctaaaagcctgatcccgaatatggctcccgttgccccggtcattccgatgacgagcttcatattgacccctcctttacgcttgaaatgtggtgtcaaatccatcatactcctgatatatccatatgaaaaatattcgttaaatctatgtatcataccttaaaggtataaaagaaaggagcgagcgttctcatggatattcggcaattgcgttatttcatcaccattgcccaagagcagaaaatcacgacggccgccaaaaagctccatatggcacagccgcctttgagccgacagttgaaacagctcgaagaagaattgggcgtcattctgtttgaccgcaataaaaagaaacaaatgaccctcacatatgaaggaaacgtctttttgaaaagagcgaaagagattcttcataagtttgaggacgctataatcgaggtacaagagctgaaggaggaggtggccgggacacttgccgtcgggtcaaccatttactgcgcagcgctcatgcttgagaaagtgtcacagatgaaagagcggtttccgcatctcacctttaacatttgggaagatgaacccgtctcactgctggagcttctggaaacccggcagattgacgccgccgtcaccaccaccttgattaaaaacgacggcattgaatcgaaggagcttgaagacattccgtgtgtattggtgctgtccgagcattcaaaacgactgtgcggagaaacgattaaactgaatgacatcgcctctttgcctctgatccttttgcgcaccgtcaatggaagaggtgtgtatgaccaagtcctccaagtttgtgaacagtacggtctcgacctccaggttgtttgtgaatgccatgactccgcgacgctcttgagccttgtatcatcaggattcggcgccacaattctgcctttgacgatgattcccgtccatatgcgctcgcatgtcaaaacggttatcatcgaagacaacccgtttgtcatgacaccggccgtcatctggagaaaagacagctacctgccgaagcctgtcagacagtttttggaattattttgatccggaacacgatgaattcccgcttatgaaaaccaattacttgactcatactaaaaaaaagttatcctttacaattgggagctattttttctcaataaaactactcagaaaagtggggaataaagaagatgaaaaaagcattattcgctttgttcatgatggtcagcatcgcaatgcttgcagcctgcggaaactcacaggacagcggatctaagtcaaaagacggcgatctttgggcttctgtcaagaaaaaaggcgtactgaccgtcggtacagaaggaacgtacgaaccgtttaccttccatgataaaaagactgacaaactgaccggatatgatgttgaagtgattcaagaagtcgcgaaacgcctcggtctgaaagctgactttaaagaaacacaatgggacagcatgtttgccggtttaaacgcgaaacggtttgacgtcgtcgccaaccaagtcggcaaaacaggccgtgagaaccaatatgatttttctgataaatacacaacgtcaaatgcagtcgtcgtgacgaaaaaagacagcacgattgcgaaagaggctgatgtcaaaggaaaaacagcggctcagtcattaacaagcaattacaataaattagcgaaagaagccggcgcgaaaattgaaggcgttgaaggcatggcgcaatcccttcagctcattcagcagggccgcgctgatctgacttacaacgataagcttgccgtactgaactacttaaaaacgtccggcaataaaaacgtgaaaatcgcgtttgaagcaggccagccgcagcagacatatttcgcattccgaaaaggaagcggcgaacttgtgactcacgtcaacaaagcgttaaaagaaatgaaagaggacgggactctttctaaaatagcgaaaaaatggttcggcgaagatgtttctaagtaacatgccggaacccgtgattgcaacagccattccgtgggatttggtgcagcagtcattctggccgattctttccgggggaatctattactcgattccccttaccattctttcctttattttcggaatgatcatcgcgctgattacggcgctcgccagaatgtcaaatatgaaaccattgagatgggtgttcagcgtatacgtatcagcggtgcgcggcactcctcttctcgttcaattgttcatcattttttatctgttcccgacatttaatattacgctggaccctttcccaagcgcagtcatcgcgttttcattaaacgtgggcgcctatgcttctgaaatcatccgggcatctatttcatccgtgccgaaagggcaatgggaagccggttatacgatcggcatgacctatcgcaagacattgttccgcgtgatcctgccgcaggcgtttcgcgtgtccattccgccattatcaaatacatttatcagcctgatcaaggatacatctctcgcgtcacagattctcgtcgcggagctgttcagaaaagcgcaggaaatcggcgcgcaaaaccttgatcaaatcttggtcatctatattgaagccgcctttatttattggatcatctgcttcttgctgtcaatcgtacagcatgtgatcgaacggcgtctcgaccgttatgtggccaaataaggaggtttcgatatgctttccgtcaaaggattaaataaatcattcggacagaatgaaattttaaaaaagatagatatggagatagaaaaagggaaagtcatcgccattctgggaccgtccggttcaggaaaaacgacgcttctgcgctgtctgaacgcgcttgagatccccaatcgcggcgagctggcattctccgatttttcaatagatttctccaaaaaagtgaagcaggctgatattctccgcctccgccgcaaatcaggcatggtctttcaggcgtatcatctgtttcctcaccgcacggcgcttgaaaacgtcatggaaggacccgttcaagtgcaaaagcgcgacaaggagcaagtcagaaaagaagcgatagagcttctggaaaaagtcggactgaaagacaaaatggatttatatccgttccagctttccggcggtcagcagcagcgggtcggcatcgcccgcgcgcttgcgattcagcccgagctgatgctgtttgacgaaccgacgtcagcacttgatccggagctggtcggcgaggtgctcaaagtgattaaggatctggcgaacgaaggctggacgatggtcgtcgtcacccatgaaatcaaattcgcgcaggaagtggccgatgaagtcatcttcattgacggcggcgtcattgtggaacaaggaccgccggcccagattttttccgcgccgaaagaagaacgcacgcagcggtttttaaatcgtatactgaatcctttgtaggagccggagaagaagcgaaacactgatttcgcttcttctttttttgggcggttatgctacaatgacaattaatgaatgttatgaaagaagggacctctttgaagcgggaattcttgatgcgctggacgttttattttgccggtctgttgattttgtctttcggggtatcgttaaccattaaaggaaaagctctcggcatcagcccttgggatgcctttcattatgggctttttcagcatttcgggctatctgtcggccaatggtccatcttggtcggcgcggtcatcgtggctttaacctgcctgttcacgaggacgctcccgaaaatcggcgctatcttaaacatggtgctgatgggaatgtttattgatttcttctcgtttctgcttcctgaggcgcacgctttttccttagcggccgtgtttttttctatcggattgctgctgatcggctgcggcgtcggtatttacgtatcagcagggctcggcgcgggcccccgggactctctgatgatgctgatatctgaaaaaacgggctggaacgtgcaatgggtgcggaacggcattgagctgacgattcttgccgcagcctgggtgatgggcggaccgatcggcgccggaaccattattacggctgttttgacggggctgattctgcgtttttctttgccgcagtcctctaaactgttaacatacgcgatctccgggcgggcaacgtccgttcattaaaaacaaagccgaaacggttttgtttttttattttcggacagctttcgtctgatatggtaggatggttttgacaatattttcagacggaggatctggacatgaagatttacggagtatatatggaccgcccgctttctgcaggggaagaggatcggatgatggcggccgtgtccgccgaaaagcgggaaaaatgccggcgcttttaccataaggaggatgctcaccgcaccttgatcggcgacatgctgatccgcaccgctgcggcgaaggcttacggacttgatccggccgcgatttcattcagcgtccaggaatacggaaagccgtacatccccgcgcttccggacatgcactttaacatttcccactccgggcgctggatcgtgtgtgccgttgattcaaaaccgatcggcattgatattgaaaaaatgaagcccggcacgattgatatcgccaaacgttttttttcgccgacggaatacagtgatctgcaagcgaaacaccccgatcagcagaccgattatttttacctcctgtggtcgatgaaagaaagctttatcaagcaggccggaaaagggctttcccttccgcttgattcattcagcgtccgcctcaaagacgacggccatgtgtccattgagctcccggacggacatgaaccttgtttcatccgcacatatgatgcggacgaggaatataagctggccgtttgtgcggcgcatcccgatttttgtgacgggattgagatgaaaacgtatgaagagctgatgtaagcatagaaaaaggagggtatcccctcctttttttgtcagcctgatatttccgcctgtttctgcagctgctttgcttcttgataaatttcttcgaacagatccgcgatgtattcttcttcaacacatgaaaatgcgattcgcaaatcggtttcattaatggatatcgtcccgattcctctcttttcaagcaacgacactcttaattcgccggcgtttatgtctttcagccggacacacatgaaataacccgagttaaacggataaggcgtccatacgtcttcatagtgcttgttttctgcaagaacggctttcactttgtcagcccgttttttcatgatattatatttcagcgatttttctttctcgtattccggtgactgcatcgcccgcagcataaacgtttgggacggatgcggggcgcttgaaatcgttcccctgataatcccttttgttttttcctcgagcacgcgcagcgctttttcgctttttgtgctgtacgtaataaaaccgacgcggaagccccacgcgtaattttccttcgtcgcgccgtctatttttacgcaaagcacccggtcgtgcacttgggcgagtttgctgaagatggattcctgaatggccgtttcatcgtaaaacagattgtaatacgcatcgtctacgagcacgacaatctctttgccggcctccgctgcctccaggatcacactgacgatttctgacgcttcctcttcccccggcgtatagcctgtcggattattcgggaaattcagcacgacaatcgccttttcttcctgctttttcagcagctcggacagccccgccgcattaaaacgcccatcctgctgaaaaagcgggtacgtctcaatggatgccttgcgccggacaccgaaaatgaaattgtaatttccccaatatttatccggcagaagcagcgcatccccttcattgacgaacaagtcggcggcaatgctcagcccgtgtgttaaagcgtttgtcacgatcggcgtgctgatgtctttgccggctaatgaaggattttcgagacgcatttttttcagccattcctgtctgagcggctcttttccctgcggcggagcataatcgtagatatcatcggggttataggcggacagtgtctcttgaatatgggaaaagtgcatggactcgccttgtgaggtggcaatcccgatcgtggcattatactttccggccttggctttcgcttccgccgattgtgtcagcacccctttcggataaaacaactctctgcccaaatcagaaagcatatgaagcacgtgcgggttttcttcagataatgttctgttcagctcttttgctgcatcattcatgtacgacaatcccttcaaaattatattccatcaaatcataacataaaatttttgataaatgagaaaactcacgggcagattttgttacaaaaaacagacagcgaatgctgtctgtcatatcctataacaattggcctgcagtgctcctgttaataatctcatatattcgttccgccactttttcagtttcacttaatatgaacatgtggccgtccgaaaactcatgaaatacgggattgtcggcccattttttccatccgtccgcatctttgatacattttttatctttccgcccgttaaaaatatggacgggtgattgaatcatgtgagaatcagacggacggaagctttcaagcgcgcggtagtcggacctgaaagaaggcaggaaaaatgacatgacctccttattctccactaactcctgcggcattccgcccagctcgataatatgggcgagaaatttttcatcatcaagatgagacacttttttcctttcaacatgcggcggctgaatggctgagatgatcacggcctgcgggtaaatcccctcccgctcaagcttttgcgccagcctgaaagcgaccatgcctcccatactgtggccgaacaggacaaacgggcggtcaggatggagattcaactcctgcttgtataaactgacaagctgttcaaaatcctcaacggcggacatttgatttgttccgtgtcccggcggttccgcggcaagcatctcacactcaccttgaagataggtgtggagcgggcggaatgatgcggaatagcctcctgcgaacggaaaacagataagctgcgttttttccgtggtatcgaacgatttaaagagctggaccattggcgggcttcctccttttctatcgtgaagctgtcagcttcggatgttccttccttaggaattcgagcaaatatgccgcattcctttcgagacattctccctgaagcatttctgcgtgactgccgcagccttttttcacacggtattcacctgtcgtggcttcctcccacgaagcgagccacggcggcatcgcaaagtccggttctgacgttaatagatctatatccgcattgaccgtgccggtgctgacggtatgcacgaaataagaataaaacgcgtttgtttttttggcgagaccttctttgacggcttcgtcattcagcgcttcgttatcccggtttaccttcatcagcgcctggacatcgctttctacggtgcggccttccaagtcgctgacgccttgttttttataggaatcaaccatgatcagccgctccactttacgtccttcggcttcaagccgtttggccgtttcaaaggcgagcgtgcagcctgccgagtatccgaacagcttgaccggtccttccggctggagctgattgatcagctctgtgtagcgttcgatgcggttgtcttcctcgataaaatcaaacgcacagattctatagccggacagctgttttgccagcggctggtacatcagcccgtaaccgagaaccggcgggaacgcaaacagtgtgtcagactgatttttattcatgatggtgagatctttcattcctttttcttcaccgtgaagcagataaccggcaatgtctgcgattgtcgtcgcttcgaataacagctgcaccgggatgtccgtaccgagctcttttttaatgcgcgacgctgccgtcatcgcttttaaggaatggcctccgagcgcgaagaaatcatcatgaatcccgatctgctgtctgccgagaatctcggaccagatgtgtgcaatcgtttcttccgtcgcgtttcgaggcccgatccattctttcgccgcctgagcctgatccggtttcggcagctgccgtttattgaccttcccgtttgtcgttaaaggaagctcttctaagaaagtaaaggtttgcggcaccatgtaagcaggaagctgttttttcaagtgcctctttacgtcttcagctgaaagcggcgtccggttcacgagataggcgttgattgatgcatctccggactcatggcggtctgcaacaacgaccgcatctttcacacccgggtattcctgcagctgcttttcgatttcttcaagttcaatccggtgaccgcgtattttgacctggtcgtcaatacgcccggcgtattcaatcgttccatccggcagccagcgtgctaaatcccctgtgcggtaaagcgtttctcccggcttgaacggatttgggataaacgtttgcttcgtcaggtcgtgacggttcagatacccttttgatacacccattccgctgatgcacagttcaccgacagctccgaacggctgaagctggttttgcccgttaagaatataaatacttgcattgctgatcggctttccgatcggcaatgaggaaatggaatccggtatatcatgcacgacgtgagctgtcgcaaacaccgttccctcagtcggcccgtaacaattaatcagcttgccaggccccatgatctcaagcgcctttctgacgtgaggcacagacgcgcgctcacccccgaataacacacagcggagccccttcagccactcctctcccgcatcggtgagaagattaaaaagtgcggttgtcgcaaacatgacattgacattctcctgccggatcagatcagtgagccgttctgtatcaagcagtgtatgttcatctgcgataatgagccgtgccgcattcaggattgatgcgtagaaatcaaaagtaaatgcgtcaaaggcgtaattcgaaacagataagaacgtatcttgttcagaaaatgccatatagtctacatgcttgaccaatccttgtatattggcatgagtggtgatattgcccttcggctttccggttgtgccggacgtatacataatatacgccggatcatcgggatcaattgcggctgcaggatcgcttgcctgttcctcaaaccgtgcttgatcatcgatgatgagtgttgttcctgtatacggcagctgagccgctttttctttcatctcctgatgtgtcagcagacaggcagccgcactgtcagtcagcatatacgagattcggtcctccggcagcttcggatcaaccggcagataagccgctcccgcttttaatacgccgagaatgccgatcaccagttcaagcgagcgcttcgtgtacaacgcgacaacggtgtctttacccgcaccttgcttttgcaaacggcgcgcaagacggttcgcttcctcatctaattcgcgataggaaagagtctggccggaatacgtaagcgccggtgcatcaggatttacattcaccgcttccttgaaccaatccgtcagaggcttcgcctgatgagtctcagccggcgggtttaagccggtaagcagaagctctctttccttttcatcaacaagtctgatcgtattgacagggtgatccggcttctggatgagctgctgaatcgctgtgagaagctgagattttaagcgcaggataaacgcctcatcaaacacattcccgttataggcaagcttaatcagcatctcatcacctggagaagccatcaggttgagatcataattcgatttctcaaaaacatggacgtcctccatatcaaagccgttttcactgttctcttcattttttgcatcctgaagcggataattttcaaacacaataatatgatcaatcagctttggctgatcggcctggctttggatgtcatagagcggcacatattgatgaggctcagactgcagcgattgctcctgcagctgcttgagcaagccgttaaatgtggtatcctcagacagcttcacccgcctcggaacagcattgataaacagcccgaccatatgttcaacgcctttgatttctgcgggacgcccggaaacgactgtgccgaagatcaaatcgccggactgctggtagcggctgattaatacactccaaaccgcctgcagcgccgtactcaaagtggtatgctgcgattttgcaagctcggtaaatgcttttgtttccgcctccggcagtgagaagagcagctctttcggctcatagccgttctcttgtttctttctttgctccgcaaatgtcgtttgtccttcaaaatcttctaagtacccgcgccagtaatgcagtgatgcatgtttatcctgcttttcaagccacttgatatagtctttatacggtttgaccggcggcaggctgtacggcttttgttctcgcagggcattgtataccttaaacagatcctgcacgacgatgccgaagcaccagccgtccaaaatgatgtggtggtagctccacacccattcaaagctttcttccgattttttaaagatggctgcccgcatcggaatatcccgcgtcaaatcaaagcccttgatcttatcctgttctttgtattcattaattttggatgcttgctcgctgcccgttaagtgtgtcagatcgatttcttctatctgaaactgccgttttttcaatacgacttggaccggcctttttactttttcgtgaatgaacacggtacgaaatacatcgtaccggtccatgatcacattcatgctttcttcaaggcatttgatattcaagctgccttttactttcattgtcatttgttcgatgtaaaagctttggccgggattcaggagagtatgaaacagcattccctcctgcatcggcgacaaataatacatgtcctgaacttgatcttttttgaactggctcatctgctccgctcccccttctgttaactgtttttgtcacgttaaattctcctcaagcatgtcaaagatgtctcccatttcatccatctcaagatcctgcgcgctgaaatcgctcggcgtaaattctttctcctctttggccgtgcaatggcggatgatcattaaaagattgtctttaaaccgctgcatctgtgtttcgacggtgcttctttcatattcttcctgattgtatgagcaggaaatgacgaagcggccgcctgtaaccatcccgctgaagctcagtgcgtataacgcctctgactcttcgctgacttgacgtcccatatcatatggagacggctcaaaccattccgttttcacttcattgtcaaactgccccaagtagttaaaactgatttcaggcgcggcgcctttttctgtttcatcggatgacagataccggagaattccgtatcctacacctttatctggaacgcgccgcactgtctcttttaccgttttaatgacggaagagacgccgtcttccttgctgatctgcagaatcaacggatattgggccgtaaaccagccgaccgtccgtgaaatattgacgttcggtatgatttcttcccggccgtgtccttctaagttgatgccgactttgccgttttccgtccattcaccgatcgttaagccgagtgcgctgagcagaatgtcgttgatttccgttccgtacggatgatgaacatctgtcagcagctgtgccgtttcttcctcagtcaattcacatttcacggccgccgtatgtttgacgagccgtttgtccggatcatggtctttcggcagcggccggagctcttccgcatctgcctgcgcccaataatccgcctgctttttcagctcttctgattgcgcaaacgtgttcagcgcctccgcccaatctttaaaggagtgggttttttgcgggaggacgatgctgttttgctgctgcgcctgtttataacctgaagcgaaatcctccagcagaattctccatgaaaccccgtccacgacgagatggtgaaccgcgattaacagatgatcgccttgttctgtccggtattgctccgcttttaacagcgggccgttctccagatcaagactgccctgaagatgatcggcaagccgctgaatctggcttttcagcatatcctcgtccgttccgtacagatcaacgatttcaaagcttgccttgcattctgtgacagggaggtatgtctgaatgatgccttccctttcttcacggtaaaccatgcggagcgcatcatggtgttcaatcaatgcttgcagggttttttccaccaggtccggatcaaagccgtctttcgcgtgaagcatgacggattggttccagtggtgtttgtccgtgaagtttttctcaaagaaccagcgctggatcggcgttaactccgcttcgccttcgacaggtccctggtcggcctgcttgccttccgtccgctccacataagagacgagctcttcgatggtcgggtgctggaagagatctttcatctccagcttgtagccgtgctggttcaggcggctcgccatttggatgcctttgatcgagtcgccgccgagggtgaagaaattatcgcttacgccgatctgatcaagaccgagcacttcctgccaaatgtcggaaagcagcgtctccatctccgtttccggcgctttgtaagcggcgcttcccgcttcaatgtccggttccggcagggcttttttgtcaatctttccgtttgcggtgaccggaagctcgtccatctccacccagaacgccggcaccatgtagtcaggcagcgtgtctttcagcgcggctttgagcgcttcaatatcgtcctgccgaggcgcgacataggcgcaaagcgcggtattgcccgctttgtcttccaccgccgtcaccgctgcgtcatgaacgtccgcaagctgggcgaggcggacttcgatttctgaaagctcgatccggtagccccgcactttgacctgctggtcgatacggccgatgtattcgatgccgctctgcgcgttccatttgacgaggtcgccggtccggtacatgcgctcgccgggcacgaacggatctgcggtaaaccgcttcgccgtttcttcctcacggttcaggtatccgcgtgccagaccgcggccggccacgcacaattcaccggcaatgccttccggctgcacctgatcgccgtcgccgagaatataagctctcgtattggcaatcgcccgtccgatcgaaagcgatccttcctcaggattgatgacgccgcttgtcgcgacgacggtgttttccgtcgggccgtagttgttgacgatcgtgtacggctgtttcaccgcccgcttcagcttgtcgccgccgacgagaagcatgcggagagaggtattttccagctccataaattgttcggccagctgcgtcggcaggaaggtgatggtcacgccgtgctcctcgaaatagtgatttaagcgggtgatatccagccggatcgcttcgtcaatgacgtgaagctccgcgccgatggtccatgtcgggaacatctcccagatggaggcgtcaaaaccgaagcccgcgtatttggcgcttttatcatccgccgtcatggcgaatgcgtcgtgatgccagaagcacaggttcaccagcgcatggtgttcgaccatgacacccttcggctgtccggtcgttcctgacgtgtaaatcatataagcgagatgatccgccgttgtttcagtctgcgggttcgcttcatcgttttcatcaagcggcaggctcagaatggagcgtccgccgtcaagcaggatcgtttctcctgtgtagccatccggcacgtccagcgcttcctgtgtgagaagaagcttggcgccgctgtcctgcagaatgtagctgatccgctcttgtgggtagtcggggtcaatcggcacaaatgccgcgcccgctttcaggacgccgagtacgcccgcggccatttccaaggacggtttcgtcaaaatgccgacacgttcgtcagccgtgacgccgcagtctatgagaatgcgcgcgatccggttcgcccttgcgttcagctcgccgtacgtccatttcgcgccgttatatgccgcggccggccggttcgcgtatcgggcggccgtttcttcaaagagacggtgaaccgttttgtcctgcggcacagagagtgtttttcctttccatgcgtcaaggagggcttgtttttcagcatcgctgatcagtgaaatctcaggcagctttctgtccgggctttccgccgcttgcttcagaatccgcaggaacccggcgctccacttttcaatggtttcttttttaaacagatcagtcgcatattcaaactgaaggccgagaccttcttgatccgtaaagccgccgagtgtcagatcgaatttcgccgtgccttggtttgactcatacggagtgatgcgcaggttctccagttccagtgtttctttatccggatcttctgtcgtcaccatcacctggaacagcgggttgcggctcatatctctcggcaggtcaagctttccgatcagatcctcaaacggataatcctgatgcgccagcgcgtcgagattggtttgtttcacccgttcgagcagcccggcgaaggtctgctctttttgcgtttcattgcgaagcgcaagcgtattgacaaacatccccggcatttcctgaacttcggcgctcgttcttcccgcggtcaccgaaccgataatgatatcgcgctgtcccgtgattttgctcaaaaagacatggaacgcggcgtgaagcaccatatgaagagtcgctcccgatgattccattaattcacgcaccgctttttccgtctcacgccccgctctgaaacggacggattgtcctttaaaactttgaaccggcggacgcggaaaatcggtcggcagattcaattcaggaagctcgccggaaaatgccgagagccaataacgctcatggtctttcatccgttcggcctgcccgggttcattctgccagacggcgaagtctttatagtgcaggttcggcgacggcagacttccgcctttgtaaaggtgagcgagctctttgaccagcatgcttctggacacgccgtcggcaatgatatgatgcatatccagcagcagcaggtgtttcttttcattcagtctgacaagagcggcccgaatgagcggagccgcgctcagatcaaacggcttaatgaatgcctgaatgataagatccgccttctcctcgtccgctgcttcaaaaatgtgcaggtcaatgtcagcctgttctgcgatctgctgcatcggctggcctttttgatcgataaaggacgtccgcaaagattcgtggcggttgatcatctgattgagcgctttctgaagccttgaaatattgacttctccttccatcagaagaacggacggcatattatagctgattgtctcccggtcaagctggttcagaacgtacatccgtttttgggcggatgataacgggtacgcgtctgcactgtctgccggtgtgatcatccgatatccctcagataccgccgatttttcgatatatgcggcaagcaggcggacagtcggctgttcgaacagcgcttttaacggaaccgttttgtccagttcagcctgaatattggcgaggagcatcattccttttaaagagtgcccgccgtaatcgaagaaattatcgtcgatgccgagcgtatccgtaccgagtgtctgtttccaaatgcggcacagcttttcctccaattccgtttccggcaaggctgaagcaatttgcgccgtttggctgacgcccggtttcgggagggcgtttttatcggtttttccgttggctgtgagcggaatgcggtctacttgcacgaaataggccggaagcatatgagacggcagtgtttcggaaagccgtttgcgaagctcagagcctttcagcccgctgtcggctttatagtacgcgcacagttccggcagcccgccttcgctgactgcgagaacgaccgcctcctgaatgccgtttacgcttaacagcacggtttcaacctcttttaattcaatgcggtagccccggattttcacctgatcatccgcacggccgataaattcaatcgtcccgtcaggaagcctgcggacgatatctcccgttttgtacatcaggctgtccggtgaaaaaggttttgagagaaatttctccgccgtcagctgcggacggtgaagatatcctctggcaagccccttcccggtaatataaagctcgccgcttgcgcccggaggaacgagctgcattgctccgtccaatacaagcgcgccggtatttgcgatcgggcggccgatgacgggacgctgctcatattgatcaagacgctccatattgatccgttccgcaatggcgccgatcgtcgtttccgtcggcccgtagtgattgatgaagtcggtatgggcgtatacgtcatgaaacttgcggacatcggacgtgatgatcttttctccgccgagcaccactaaacgaagcgagctgaaacggcgttctgacgtaaaacgggctgtattgacgatcatatggaacaatgacggcgtcagtttcatatacgtaatgccgtttttctgtatatactcaccaagctgatcaggcgcggtgtacgtctctttcggcacaatgtgcagctcgccgcccgcctgaagaatcgggaatatggccgtatagccgagatcaaatgcgtaagaagacagcagcacggatttgtcagcttcggtcaaaccggcttcacggctgaaccatgtgacataattgattagattgcggtgttccagctggacgcctttcggtttgcccgttgttcccgaggtataaatgatataggcaagccggtcggcgccggactccgtttcaagccggtcggcgctttcgttctgccattctccgtcttccattacgaccgtttttcctttataaacggcggccgcggtcatgtttctctcattgacgaccagaagcttcgttccgctgtcttcgagagagtagcggattctctcttcaggagtctccggatcaatcgggagaaatgccgctccggctttcatgacgccgagaatcgcggtaatcaagtcggccgaacgatccatcataatggccacgatgtcctcactgcccgttccgcaagcctgaaggtgtcgggcaaaccggttcgagcgttcatcaagctcacgatatgtcagacttgttccgcccgcaaccgccgtgagatcaggcgttttctgcgcttgccgttcaaacagcgaaacaaaagtgccctcaggcagatccgcttccgtccgtttttcatcagaaaggagcgcttcccgctcaggagcggacagcaggcttgcgtcggccagctgaatatccggattttcggcgcaggctttaatcagattgacaaaatgagcgctccagcggcggatggtttcgtccgcaaataaggctttcgcgtaatcaaagctcaatccgacctcttctccgcgctcagccgcttctaaggaaagatcaaatttagcgacatgatgatgcatggagtaagaagaaatctccaaatctccgagccgcagggccgggatctccatgttctgcatattaaataacacgctgaacagcggactccggcttgtgtccctcgttaacggcagtttttcaattaattcttcaagcggatagctttgatgctcaaaagcttgaaggctcgccgttttcacttcatccagaaattgcttgaacgtttttttgccggcaggatgcgaccgaagcgcaactgtgttgacaaacatgcccggcacgtcttggagatcaggatgctgtcttccggccgccggagacccgactatgatgtcttcctgccccgaatatttggacagcagcacttgaaaagcggctaacaagaacatgtacatcgtcgtatccgtatcagccagcagcttcttaatctgcgccgtcacctgtttatcaagcccgaagatgacgcgttccccttcaaaactgcgctcggcaggacgcgggaaatcaagcggcagatccagcaccggcagatcgcctttgaacgtatcaagccagtaagcttcgtgctgatcaagatttgctttttcacgctgccagactgaaaaatccttataatgaatctttggcagctcaagctccgtgccttgataaagcttcgcaagatcaccgatgaaaatgcccattgagcttccgtccgtaataatgtggtgcatgtcaatcagcagaagatgccggtcttctttaagccggatcagcttcgaacggaccagcggcgcacgattgagcgcaaacggcctgataaaggcttttgtcagctcttctgcatcttcttcccggccctcggcggtttcaagctcaaacgacacatttttatgaatggtctgcacgacttctccatctgccatgtcaaacgacgtacgcagtgtctcatgacggttgattaatgcctgcatggcctcttcaagacggtttttgtctactgatccttccagcagaagtacagcagggacgttgtagctcgtgctggcctgtccgagctgattaaggatatacatcctgcgctgtgctgaggaaacaggataatgcttctgataaggcgcttgtcggatcggttcaaactgctgttcctcctcggtctcatgctccaaataatgcgcaagctcctgaatggtcggcttttcaaataacactttaatcggcacttctttttgaaagtgctcctggattttagcggtcatcatcatggcttttaaagaatgtccgccaatcgtgaagaaattgtcagtcacacccgcttttacaccgagaatgccttcccaaatgtccgcgagtttctgctccgcttccgttttcggcgcttcgtattctttttgaacggcttcagcctgaggctcaggcagcgcttttttatcaatctttccgttcgccgtcagcggaaactgattcatctggatgaagtgcgcgggaatcatgtattccggaagtgattccgaaagcgttttgcgcaggtcttccggcgaaagggcttggtctgcggtaaagtaagcgcagatttcattttcatccgctttatttttccggatcacagccgcagattccgtcacattctccgcctggctgattttcgcctcaatttcgccgagctcgattctgaaaccgcggacctttacttggttgtcaattctgccgagaaactcgatcgtgccgtccggaagccacttcgccaagtcccccgtccggtatatcgtttcatccggtctgaacggatcgcggacaaactgcttctccgttaattcaggcagattcacatagcctcttgccactccgcttccgccgacacacagctccccgggcgcgccgatcggctggaggttgcggttttcgtccataatgtacgcagtggaatttccgatcggcttcccgatcgggatcgaaccgtcgtagtcctgatcaatgagaaaactcgtcgaaaacgtcgtattctccgtcggcccgtagccgttccaaagcgacagctccggtgatgccttcctcactttgctgacgatatgcggcacaagcgcatcaccgccgatgatgaggtgccggagcgtgttaaacatgccggcatccttttgggcaagctgattaaacagcggagacgtcagccacatggtcgtgatccgctgctctttcagaaattgggcgaatcgtccggcgtcaagcagcgtctcttttttcaccgggtgcaatgccgctccgttcagcaatgcgccgaagacttcaaaggttccggcatcaaagctgacggctcccgtttgcgccatccggtcttcttcatgaaccggcacgtaattcgaaggtttgacgagcctgatgatatttctgtgttcaatcatgacgcctttcggtttgccggtcgatccggatgtatacatgatatacgccaagtcgttgccgccggccgggagattcaagtctgttccgcttaccgtttcatccgcgctttcattcagcatgacaatcgggacttgcaatgtgcccgcttgttcttgatagtcctgaactgtcagcacgagccgaatcgagctgtctgccgccataaagcggagacggtcctccggaaaagccggatcaatcggcacataggcgccgcctgcttttaggacggcaagcattccgataacggtttccgcagaccggtcgttcataatagcggcggtccggcctttttccagcccgctcttcacaaggtgtctcgccaggcggttggccgcttcgttcacttcacggtaggtccattcgcgtccctcttcttttatcgcgatgcttgcaggcgtccggtttgcctgtgcttcaaacaaacggtgaacggcctcctcttccggaagcgccgttttcgtatcattgaatatctcaacaatctgccgctcttcttcgcctgaaacaaggccgagttcccgcacgggcgcgtcaggcgttccgaccgccgctttcatcatgcaggtcagatggtgcgccgttcgttcgatggcatcatgtgcgaaagccgctccgttgtatttgattttgacggtccacgtttttcccggatacacgatgagattgaaatcaaagctcgtctgctcaaaagcatgttcaactttaatggaaaagccgagtctttcctccatgcccccgttttccagctctttgtccagcggatagttttcaaacgcgaccaaatgattcaagaggctgccgtccagagcggagcgcttttgaatgtcatagagcggcacataatcatagcgctcggcttccacggcgtttttctgaactgccgccatcacgtcagaaaaggctgcatctttgtcaatcttgattctgacaggaatcgtattgatgaacagccccgccatcgtttcaatgccgttgatttctgaaggacggcctgatacgacggtgccgaacaccacatcgtctgtatagttgtatttgctgagcaccgcaccccaaacggcctgaaacaggttaggccccgtgacttgatgccggttggcggtctgctgaatctgcgcgaccagctcttcatcccagacaaaagaatattcttcattttggtagtctttcttttctgatgccagacggcccgggagcaggctcggctgttcgaaatccgccaggcggctgctccaatattgttccgcctcctcataatccctgcctccgagccatttgatatagtcagagtaaggtttgccctggcttcccccggcgggccggccggcacgaagcgcttcatagttttgaaacaggcttttcatcaaaacgcccatactccagccgtccatgacgatatgatgattgctccagacgagatacagttccttctcactgagcctgaacaccgccgctttaaagagaatatccttcgccagatgaaagccctgctgctgcacatcgcgtttatagcgttcaatatattcggtttggcgcgcttcatctaattgactgatatcttcatagtgcaccttcgtcttccgctctgctaatacgacttggcgcggtttttgaagctgctggtgcacgaataccgtacgcaggatgtcatatgtccgaatcagctcattgacacttttttcaaaaagctcaagctgaaagcttccgtgaatcctaagctctaattgtgtgaagtaggaggaagaatgcggatcaagcagcgcatgatacagcattccctcctgcatcggtgtgagtgcatacaccttttgaatcgattttttgctcatatgtcacctctgtcttttctgttagagaatttccattaatttatcaagttcatcaagcgtcagatcatcatcgccaagatcgctaggcgtaagctcaggtccgtcttgggccaggcagtgatctatgattttcaagaggtgccctttaaagctgtcactgaacgattgaatggttttttcatgaaattcgagagaatgataggcaaacgtcatcgtcatctgcccattttctataaatccgacaatatcaagcgcattcggcttctctgtgtcagggctcagcgattgtcctgacggcatcccggatcttgtaaataagccggaatccgacatctcattaaactggcctaagtagttaaagctgatatccggatcaatctcaaatgaaagaccctctttatgctcaggcgccgttacataacgcagaatgccgtagccgactcctttgttcgggatgtgtctgatgtcttctttcatttgtttcagctgatatgaaagatcgtcggcgtgcttcatctcaaggatcatcggatacatgctcgtaaaccatccgaccgtccgggtgatattcaggccgtcaagaatgtcttcgcgcccgtggccttccaaatgaacgccgatcgtgtcttcacccgtccactctttcagcgccagtccgagcgccgtgagcaggatgtcgttcatttccgtatggtaggcttcatgtacgtttgtcgtcagctgttcagtttgttcaggcgtcagagagaaactgaccgttctcgtatgtctcatgcgctgatcgccagactgcctgtctttcggaagctgagtgcatacctctttctcctcaagccccctccagtaatccgcttctttcagaaacgccttcgtatttgcgtattctttgattctctcagcaaattcggcgaatgaatgtgttttcggaggcagcgccggttcattgccttgtttcagctgcgtataaacggacgtgaagtcctccagtaaaatccgccaagatacaccatccacgactaagtgatggattgcgagaagaaggtggtctccatcttcagcccggaagagcccggccttcagcagatgtcctgtttccagtgaaatactgctttgaagacggtctgcttcccgttcgatacggtcctcatgatcttcagcaggtccgttcagctcaaagacgttcagttcaacagacgcatcctcaagccctctgtaatacggtttttgttcacgataaatcatccggagcgcatcatggtgcaccgtcaggacatgtaatgttttttctgttatctccggatcaaagccgtctttcgcatgaagcatgacggattgattccagtggtgtttgtccgtgaagtttttctcaaagaaccagcgctggatcggcgttaactccgcttcgccttcgacaggtccctgatcggcctgcttgccttccgtccgctccacataagagacgagctcttcgatggtcgggtgctggaagagatctttcatttccagcttgtagccgtgctggttcaggcggctcgccatttggatgcctttgatcgagtcgccgccgagggtgaagaaattatcgcttacgccgatctgatcaagaccgagcacttcctcccaaatgtcggaaagcagcgtctccatctccgtttccggcgctttataagcggcgcttcccgcttcaatgtccggttccggcagggcttttttgtcaatctttccgtttgcggtgaccggaagctcgtccatctccacccagaacgccggcaccatgtagtccggaagcgtgtctttcagcgcggctttgagcgcttcaatatcgtcctgccgaggcgcgacataggcgcaaagcgcggtattgcccgctttgtcttccaccgccgtcaccgctgcgtcatgaacgtccgcaagctgggcgaggcggacttcgatttctgaaagctcgatccggtagccccgcactttgacctgctggtcgatacggccgatgtattcgatgccgctctgcgcgttccatttgacgaggtcgccggtccggtacatgcgctcgccgggcacgaacggatctgcggtaaaccgcttcgccgtttcttcctcacggttcaggtatccgcgtgccagaccgcggccggccacgcacaattcaccggcaatgccttccggctgcacctgatcgccgtcgccgagaatataagctctcgtattggcaatcgcccgtccgatcgaaagcgatccttcctcaggattgatgacgccgcttgtcgcgacgacggtgttttccgtcgggccgtagttgttgacgatcgtgtacggctgtttcaccgcccgcttcagcttgtcgccgccgacgagaagcatgcggagagaggtattttccagctccataaattgttcggccagctgcgtcggcaggaaggtgatggtcacgccgtgctcctcgaaatagtgatttaagcgggtgatatccagccggatcgcttcgtcaatgacgtgaagttccgcgccgatggtccatgtcgggaacatctcccagatggaggcgtcaaaaccaaagcccgcgtatttggcgcttttatcatccgccgtcatggcgaatgcgtcgtgatgccagaagcacaggttcaccagcgcatggtgttcgaccatgacacccttcggctgtccggtcgttcctgacgtgtaaatcatataagcgagctgatccgccgttgtttcagtctgcgggttcgcttcatcgttttcatcaagcggcaggctcagaatggagcgtccgccgtcaagcagaatcgtatctcctgtgtagccatccggtacgtccagcgcttcctgtgtgagaagaagcttggcgccgctgtcctgcagaatgtagctgatccgctcttgtgggtagtcggggtcaatcggcacaaatgccgcgcccgctttcaggacgccgagtacgcccgcggccatttccaaggacggtttcgtcaaaatgccgacacgttcgtcagccgtgacgccgcagtctatgagaatgcgcgcgatccggttcgcccttgcgttcagctcgccgtacgtccatttcgcgccgttatatgccgcggccggccggttcgcgtatcgggcggccgtttcttcaaagagacggtgaaccgttttgtcctgcggcacagaaattgtttttcctttccatgcattgaggagggcttgtttttctgtttcattcaccaaggaaagctcagaaagcttcgcagccggattttccgttgcggcttttaacagttgaagccaataatgcttccacgtctctgccgtttccggtttaaacagcgcggtgttatattcaagcacaaacgttaagccttcgtctgtgtcctcagccgtcatcgtcaggtcaaacttggctgtttttctgtcaaacgggtggtgcttcagctcaattccttccatgaccagatcttcagcatttgcattttgcattgagaataccgcatcaaacagcggatttcggctcgtatcacgctgcacctcaaccttttgcagaaggtcttcaagcggataatcctgcgcgtcaaatgcatgtaaagcggtttgtttcacttctttaagatagtccgtgaacgttttgtccgcttccggatacgtacgcagcgcgagtgtattcacaaaaacaccgatgacgtttgcgagatccgcatgtgaccgtcccgcaaccggcgagccgacaatgatgtcatgctgtccgctcagttttgagagaaaggcgctgtacgacgccagcagcaccatgtacatggtagaatccgtttgtttcgcaagactgcgaagagccgacgtctgttcctcagtcagagaaaagaccagcttgtctccttcaaaggtttgcacggccggacggctgtaatcagccggcagcgtcaataccggaagctcgccgtcaagctcccgaagccaatgctcctcctgcttgcggtactgctctgattgaataaatttctgctgccataccgcatagtctttataatgaatccgcagcggctcaagcgtttcgccgccatacaagcgggacagttcatctatcagcacgccgactgaagcgccgtccgaaatgatatggtgcatatcaaacagcagcaggtggtcatgttcagccagcttgaccagccccgttctgacgagaggaagctgatccagacggaacggccggataaagctctgaataatccgttcagcatcttcttcagaggcttcataatattccatgtcgatataagcttccgcccatatacgctgaaccgtttctccatcctttatgtcaaatgtcgttctgaaggcttcatggcgttctgtcagctgtttcatgacggatttcagcttttctgcatcaagctttccttttaaacggagcacagacggcatgttatagcttgtttcagcgccttccagctgctgaagcacgaacatccgcttctgcggtgaagaaaccggatacgtttcccgctccgcagccggtgcgatgctctcagccgccttccgctcagccccttcaatcagctgcgccagcccagcagccgtcggagaagtgaacagatcctttaaggtaagctgcacgccgaatgtcttctggataagggccagcagtttcatccccgctaacgagtggcccccgatctcaaagaactgatcatggacgccgacccgttccatttgcagcacctcagcccaaatatccgccagtttttgttctgtttcattgcgcggcgccgtatatgacacggcattcgctgcggtcacatccggcatcggcagcgcccgcctgtcgatttttccgttccctgtaagaggcagttcatccaattgaataaagacggacggaatcatataagccggaagatccttcgccgtatgctccctcagctcccgggaagatatttccctgaggccgacaaaatacgcgcaaagaagtttgtcacccgcgccctgatccacagcgagcacaatgcattcctgaatctgatcatggctttgaagctgatgctcaatttcgccaagctcaatccgctgaccgcggattttcacctgatggtcgatgcgtccgataaactcgatatcgccattcggaagccatctggccaagtcgcccgttttatacatccgttcaccttccttaaacggatgctttacaaatttttcttccgtcagttcaggacggttgtagtagccttctacgagaccttccccgctgacgcacagctctcccgcgatacccgccggctgaatgcgtccggctgagttcataataaagacttccgtattgctgaccggtttaccgatcggaacggagagcgtatcctcttcaatgacatccaccggatggtatgtcgcaaacaccgtgctttccgacggaccgtacatatgaagcagttttcctttcccgactgccgccagcgcctttttgacatgttctacagacgctctttcgcccccgaacatgattttccgaagcgtcgtcagacaggacggctccatatcaacaagcaggtggaacagggccgtcgtaatcatcagaatgctgacgttctcccgtttgatcacacgggacaggcgcgacatgtccagcaccgtatctttcgggacgatcacaagctttgcaccgtttaacagcgaaccgaacatatcaaacataaaagcgtcaaagacgtagtttgacagaccgagcactgtgtcctcttcagaaacggtcaaatagttcgtgttttttaccgtccgcaaaatgttggcatgtgtgacgatgtttcctttcggcgttcccgtcgtgcctgatgtatacgtgagattggcaatcgttttggaatcaaacggcaatgctggattgcgagagtccttttcatagctcgcctcatcatcagcaagcacaatgacgccttgaaaaccggccttttccgcaagcggcttgaggctttgctgagtcaggagcacattcgccccgctgtcgcggaagaaatgctgaatccgctgaaccggatgctcaggatcaatcggcacataggcggaccccgcttttaacacagccataatggaaacaatcatgtccattgaccgttcacataaaacagccgcggttttcccgccgcctccgaccgaaagaatatgccgcgtaagcctgttggcgcgttcattcagctgctgatacgacagagtttccccttcgaactgaagagccgtccggtcagggttctttcgggcctgttcttcaaagatctgcacgatcgtttgctctttcgggtatgccgtgcgctccggattgaaccgctgtaattggttcaaagcctcccgttcagaaagcagatcatattcgctgattttcgcatccggctgagctgccgcactctccagcagacggacatagtgcgcaagcatgcgatccgcagttgagcgcttaaacagcttcgtgcaataatccaaatcgagcgcaatgccttccgctgtttcccgggcctgcattgtcagatcgaatttagcgatattgaagttggtttcatgaagagacagcgtcaggttgccgatctccggaattccgtccgaagcattttgcagactgaacatcgtgtcaaatatcggatgcctgctcatgtcccggggcacgttcagctcctcggtcagccactcaaacggataatcctgatgggaaaacgcgtccagcacctgtttgcgcacatgacctaacaagccggcaaatgtctgatcctgcttcacggagcttcgcagcgcaagcgtgttgacaaacatcccgataagcccctcggtatcagagtgatttcttcccgctgacggtgttcccacgatgatgtcttcctgtcccgaatacttagaaagcagcgtatagtatgccgataacagcaccatgtaaagggtggctccgtttttctcggcaagcttctgcagccgttcccgcagcattttcggcagcttggcggacacgcggtcaccttcaaagctttgcacctgcggccgcggataatcagggagcagctgaagcaccggcagttcgccgctgaagacttctttccagtacgcccgctccttcttgtagccttctttcgcccgttccgcctgccatacggcataatctttatattgaatgcgcaattcaggcagctgatttccgccgtagatgtcagccagttccttcagcatgatggaaatagacaccccgtcagaaatcaggtgatgcatatcaaacagcagcatatggcgattgtgaccgagcgtttgcaggccgattctgaacagcggcgcctcagataaatcaaaacggcgcacaaagtccttcatgacctgttcattcgttcttccgcgcgcttcgagcatttcaatatgaaacggaacatgttcgtgaaccacctgtctcggcgtgccgtcctccgattgaaacgatgttctgagcgcttcatgcctgctgattaaggcagaaaatgcacgctcgagcttttcaaggtctaaagcgccctcaatcacggccgcagccggcatgttatatccgactcccgcatcttcaaattggctcgcgatataagtccgctgctgagcgagcgaaagcggatagctcgcctgcttctcagccggctcaatcgccctgaatgccggtccttcgtttcggttttccgcataatcggcaagcgccgcaatcgtcggatgctcaaacaagtattgcagcggaatttcaacgcccatttgcttatgaattttcgtcagaagcgtcattgcctttaatgaatgaccgcctgactcgaagaaatgatcataaatgcccgccttgtccattccgaggacttcctgccagatgacggtgagcgtttcctccgtttcgtttctcggcgcggcatattcggatgagctgacagcctgcacatcaagcgcaaacagctttttgcggtccgccttcccgctcggcgtgagcggaatttcgtccgtttttgtaaagtaagcgggcaccatgtaatcaggaaggtgcttggacacatactccctgtactcggcagggtgaaactcggttcctttttcctgaacgatatatgcgcaaacatctaagctgccctgctgatccggccgtgccagcacgacggcctgcgccgcccccggagcttttctgagcaccgtttcaatttctcccagctcaatacggtagccgcggactttcacctgatcatcttcacgtccgatatattcgatcgtcccgtccggcagccagcgcgccatatcacccgtgcggtacatgcggccgcttccgttaaacggatcttgcaaaaacttctctgcggtcaaatccggaagatttaaatagccgcggcctacaccgtcacccgcgatatacagctcaccggccgtgccgtcgggctgaagccgctggtgcttatccaatatatacagacgggcgttgccgagcggttttccgatcggaacgtacgccgcctgttgattcattccgttatcggcggacacctgatgcacggacgcatctacgcacgtttctgtcggcccgtagacattcgtcagacgcggcgccctgcccgattgatgaaagaggttcatcagctgttcagcaacagcggcggacaggccctctcccccaatgagcatgtggcgcaattcaattccgctgacatctcccgccgcaaccatcatctgcagatgcgcaggggttccgtcagtggcttcaattcggttttgacgataatagtccagcagtgccgagccattcgttacagtcgttttcggcacgatataaagcgtctgtcccaaaagaagcgaggcaaaaatctgtttgacggacgcatcaaaatgaaacggagccaaaagcgccattcttaatgtctgctcaccgcattgataaatctcctgctgcagtgattgcaccagatgatgaacttgccggtgctcaatcatcacgcctttcggccgccccgttgtacctgacgtgtagatgatgtaagccagccggtctgattgtgtactgacaccgtccgcagccgtttcaaactgaacagcctcgtcaaaatcaatccgttcggcatccgctgcaggcgcctgtattccggcctctgtcagaacagccttcgctccgctgtcctccaaaatgtactgaatccgatccgccggaaagtcaggatctatcggcacataggcgccgcccgctttcaaaattcccaatattgccgcaataacacgctcagaacggccaagcagcaccgcgacaggagaatcggctgatatcccggctttaagaaggcgtccggcaattcggcctgactgttcatgcaatgtgcgataggacaatgttcggccttcatacaccaccgccggtttgtcagacagtgacttcactttctcttcaaacagccccggtatcgtcatctccccgcggtaattcaccggattaccggaggcccgtgtcagcagccgctctttctcggattcagaaagaagagtaagctcatcaattatgcgatcaggagatgaaatcgcatcttcaatcagcgtgatcaaacgttcagaaacagatacaatctcctctcccttgaatatgtcgctgcgatagtcaaaatcaatcgtcaatttcccagtgtcccatcgttccttcacatgaatcgaaatatcatttgtaccgcttccgctgaaaatagggtctgtcaggaaggacagattctcttttttctgccactgcatcacctggtactccagagccaccgtaaacaatctgctcagcgaacttttcgaagcgcgcaaatcattgacaagcaggttatacggatacttttggtggcggagaattttcatcagatccttcatccggcctttaacgaattccaagaacgactgtcctccgtcaacgcttgtccgcacaggaaccgtagatacgaacatcccgagcatctgcttttctttcgcattcgtccggtttcccataaacgtacccgtgacaacgtcatcccggccggtcactttgtagagataagtgatcaaagctgattggaacagagatagtacgctgactttatgctcctcgcagaatgaatgaatgcggccgtataagtcgtgaggaatttcttgagaaaaccgtttcgcatcaagacccgcatctgcctggctccgtttcagggacacaagctccggcacggtctcgaactgcccgttccaaaaatcccgatcctttttaaaccgcttcgactgcacatattcctgctcagtcagcacatgctcgataaaggaaggaatctccgtctgttccatacttgctccgcccgaaagctccaaataaatatcagtaatcgcattgcccagaatcgtcatggaaatcccgtctgaaataatgtgatgcacattaacgtaaaaccagacctcattttcgctgatggtatacacggaaaaacggaataaatcctgatcatataatgccagaggcttgcttgcctcgtcacgtccccattttgacagctcttccgcagagcagccggcttgcctgatgtctgtatgttcgatagtcagcggacggtaatcgctcacatattgaacgggctccccctcatcatcaagccgcagacggattctcatcgactcataccgccggacgaattcctgtatcgctttctcaacgtaatgagcctgtacgccgtcgtcagaaatgagtttcccgaacccggcaagatttgaaatacttgtgttcggatagaatttttctgtataccagatacgtttttgagcatttgttaaaggataaaaagttatttccatatgtgtgcgcctcccctttttaagataaaattgtcaattctcccttagaaacagcctccctcaatgtccctaactcattatcaagccaaaagaaccacttacctccaaaacgatcccgattcaatcaccgccgaaatccgcaatccactcacccgcacagtccgaaatgcggctcaaatttatgagaaatcaagacaagaatccaatgtttgtaagcaacagggtttacctatttcttcatgaattactatatatctacttacgttcactttatatgaaattattgtttttatcaccgaaaaatgggtgaaaagtttcattcggcacaccgaaaaaaattccgacaattccagagggtattttgcggcatcccgcaatttatttttaaaaatattatttatgtaaaattaaaaatctttaaactatagtataaatctctcgaatatccagttatggcagaatgaaaatagttttcatatatgagctgatggggaaaaaacagcgcaagaaccgaaacaggagatttaatcgttcgcaatatgatttcattaaaccgcaaaaaaagcactctattttacatagagcgcttcaaaaagattcctttattgcagttttatcaatgttgattaattccatatattcttttccccacttatacatggcgtccaaaatcggcataagggtctctccttgctccgttaatgagtactccactttcggagggacgacagggtaaacctccctgtgaacgatcagatcctgctccagctccctgagctgattcacaagaattttgtgcgtaatatccggaattaaagctttcagctcattaaaccgctttgttccttcttttcccaggtgccacataatcagcattttccacttcccgcctatcacggcaagcgtcaattccttttcgcaattaaacgttttctcatccattcggctcacgggccattctccttcctcttactttttgtacgttcatcatctattcatacacgcttacttttttacacaactttcatcagtttatactaccacgcagttttgctgaaacaaagcgcattgcctgcggggacagtatcctcaaagtaactattagacttcaaagtgcgtacttctcaacatgcggggcactctatagaatgtaaatacatgaaaaagaggagtggatataaagtggaattacagctggcattagacttagtgaatatcccggaagcaattgaacttgtgaaagaggtcgaacaatatatagatgttgtagaaatcggcactcccgttgtcattaatgaaggcctgaaagccgtacaggaaatgaaatcagcctttcctcacctgaaagtgcttgccgatcttaaaatcatggatgcaggcggctacgagatcatgaaagcggcagaagcgggcgccgacatcatcaccgttttaggagcgacagacgactcaacgatcaaaggggcggttgccgaagcaaaaaaacagcagaaaaaaattctcgtcgacatgattaacgtaaaaaaccttgaaacacgggcaaaagaaattgaccaactcggtgttgattatatttgtgttcacacaggttatgatcttcaagcagaaggaaagaattcattcgaggaactgacggcgattaaaaaagcggtcaagagcgctaaaaccgcaattgccggaggcattaaacttgatacgcttcctgaagccatcaaacaaaacccagatttaatcattgtcggcggaggcattacgggagctgacaataaagcggatgctgctgctaaaatgaaacagctgatttcacaaggatcatgaaaacgactgaatacttacatgaaatactcaatgaaatatcccgcaccgcagcattaatagccgacagtgaagctgacaagcttgcagatgagattttatcggcagatcaaatcttcacgtccggagcggggcgttccggctttatggctaaagcgttcgccatgaggatgatgcacatcggcctgaacgcttacatcgtcggtgagacgcttacccctcccctccaagaaggcggtctcgtcatcatcggctcaggctcaggcgaaacaaaaagtctgcttcatacagctgaaaaagccaaaagccttaacggcatcatcactgcattaacgattaaccccgattcaagtctcggcaaacttgcggatcttacgataacgattcccggctctcctaaggaagagaccggcggagacagaaagacgattcagccgatgggttctttattcgaacaaactcttctgctgttttacgatgcggttattctaaaaatcatggagaaaaaagaactgaattcagcagacatgtttacaaagcatgcgaatctggaatgatttactgacggccttcttatcagatggccgtctttttatcgtcttgttgcgcacggtcatgcaggccaaggttttcgggtcggacactcgcagacgaagatatcctgccggtgagcttatcgctataataagtcaattgacgatacggccgcaaccgttcatttctgaatagggaaacggcaaaaaacactttctgatcggatatttaatgaataaaattgatttgtgcggatggttttacagatattcagctgaattgcggctgagaaatatattttaacagctttacagccggccgattctgctttattcttggaccagctttacagcaatttaaaactggaggtgattgatactcttgaaaacattaaaagcactgctgcttgttcttatcatcattgccggagcagtcgcggccctgatcaagggtgatcttttctcagataacgagcagaccgttcagaagagtgattacgacaaagtaatcctatttccgtccgatcgatatccggaaacagcaaagcatattaaggacgcgataaaagaagggcattccagcatatgcaccattgacagagacggagtacataagcggcgtgagcaatctcttaaacatgtgcctgtcaaaacgggatacgatagggatgaatggccgatggcggtttgtaaacagggcggaaacaatgcctccgtagaatatatttctccggcagacaaccgcggagccggctcttgggtcggacaccagcttaccaatgatcccgacggaacgagagtattatttaaaatcaagtaaaaaaacaggaggaacagcgcattgaataaatcatggaaaccgcaagaactggccatttcgtatcatcaatttacaatcttccaaaaagattcagaaccgcctgttatcgattggaccgatgaagccattgaaaaaggatatgcggaagctgacggagctgtttcattcgaagcaaggagaaatacgagggcatttatcgtcttcaggcttaacacaagtgaaccggtactatcctatgagaaaaaagcgactgttccctttgaggctgtaaaagatggaattgagattgaaagcgtgatgtcaaagcggcttttctttaatattccgaaaggccgatacagccttacctgttattcagtgcctgccgaaatatccgatcttcatgcggatacgtatattattgatgcagacgcaatgtaaaagaaacccctgagagaatcatatttctctcagggaacttttataaacttttaccgtttgtttcaattacattctggtaccaataaaaactgttttcctgatccgtttcaagtctttttcatcttcttcatctcgattgatatacacaaaaccgtagcgtttttgatagccgttcagccagcttaaacagatccgtgaatgaccagctgcagcagccgatgagatgaactccgtcactaatagcctctctgcacagttcacccatactgaaggtcctttaccgtcttattccaagctccttcaacctgataggcagccgaagctgacccccatagaaatgtatcagggaacagaccctgttttttatgtatcatgtgtttcatcctcctgatgcgtatgatattgatatcatacgttttgaaacgcatttcagagcaatcccgataaaaacaaaaaagcatccggcttgccggatgcttaagaatgatgatgccgcttttccaatttatgaggcggaggcttcgggacaaagccattttgtttcatcatattaaagcgcctgtccatatgctgtttaatatgttctgctttttctttcggcaggaccccgtactcaacatatttggatatgacatgtttgcgtttttcgagcacttctttttcaagtgattcaatttcttttttctgctgttccgtgagtgacattgttgaaggcatttttgtttcggcgtgtgccggcattgtgaaaaccattgctgtaatgaaaaacgcagctaaagacaatgcagcttttttcatgactctttcctcctttaacgtttgttatatgttgctccctcatccattttttatgcaaaaaaagagcgaaattattcgctcttttcaatcgattcgtccggcagtgcgtatgtgacatacgttcccgctacaaaatcgtggattgaccgtttgtcttctctcattccgaccatgaatgcgctcacgatcacaccgattccaaacgtcacgccatatatcaggccgcccacaagcactctcaaaatcatagtaagaaagcctgcctggtttccgtcttttttgacgatgcggataccgcagatctttttgccgataacataaccgttccagtatacagggagcaaaataccataaagagtcaaaatgatgctgatcattgcgctctcattcgggtcttttcctgttgccagcataaaaataatcgccaaaggcactgaagtaattaaatagtcgagtacaacggctcccaatctgatccaaaatcccgccggtctgtaaatattcatcatgtttcccctcgctatggcttcaaaatcactttaatgtcgccatcttcttttttgtcaaatatatcatatgcagcaggagcttccgcaagactcattttgtgtgtaatgatatccgtcggatcaatttcattttgttcaatcatttgatacagcatcggcatcagatgaataacgggtgcctggcccatttttaaagaaacgttgcgtgtaaaaaaatcaccgagcggaaagccgtccgcttcagaaatgtatgcgcccgtgagctgcacggttccaaacttcttaacggcttctgatgctataagaatcgggctgatcgttccgaactgattcggtttttgctctgctttttcttttgaaagcggcgtgccgtccattccgacacaatcaatcactacatccgcgccccctgacgtttgttcatgcagcagtttcccgatctcatcatgttctgaaaaattgaaggtctctgctccgtttatgcgtctcgcatgttcaaggcgatgcgggacttgatcaactgcgataacccgtttagctccttttttccacgcgaatttttgcgccattaagccgatcggacctgatcccaaaataacgactgtatctccttttttcactccgctgtgctgaacgctccaaaaggcggtcggcatgacatctgacagaagcagcacctgctcatcttcaagctcactgtctgccggaaccagaaaagaagagaaatcagcaaaaggaacacgtaaatattcagcctgcccgccgggataattaccgttaaactccgaaaaaccgaataaaccgccggcatctgtatgaggatttggatttgattcatcacactggctttccatctggtgcttgcagtaatgacattctccgcagccgatgttaaaaggaatcacgacacggtcgccttttttcagctttttgacttgactgcccgtttcttcaacgattcccatcggctcatgcccgacaatataacccggatcggcgggtattccgtttttatataaatgaaggtctgaaccgcatatcccggttgcggtgattcgaacgatgacatctctctcatcttgaatggcgggtgccgggacttctttcacttccatatgttcttttccttggtatgtcaatgctttcacacttggtcagctcctttttcatcactccttcccttttcacctgcttctaaacttggccggtatgttattcggcccgctgaatatcccattgaaaaggatcttcaagctgcgaccaatcagaatcgaactcagactgcgtgagcaggcactgatccaattcctttgtaatggcggcttcatctaaatctgttccgataaacaccaagttcgtatgacgatctccgaattggtcgtcccaatcttccagaatctccggttcctgctttttgatctgctcctgctcaagtttcggcattgccgccacccaataagaaacaggctcaatcgaaaccgccggacccgcctgagacatcagcagcgcaaggctgttgcgggttgcgcaccaaacaattccttttgcgcgcacaatgttgtcaggcattgattgatgcagccagctgtcaaaacgaacggtatgaaacggcagacgccgcgagtacacaaacgaagtgatgccgtactcttccgtttccggagtgtgcgcttcatgacctgccgtcagttcctttatccatcctgctgatgaactcgcttcctcaaactcaaataaaccggtattcaatatgcattcggcgggcacttctccgcgaacggaccggatcagtctggcacggggctgtaatgcgcgaagaaccgtttccagctgttcaagctctttttcgcccaccatgtcgcatttatttaaaatgagcacatcacaaaactcaatttggtcaattaataaatcggcaatctcccgttcatcctcttctcccgccgcttccttccggtcaagaaggctgtcaccggactggaaatcatgccagaagcggtttgcatccaccacggtcaccattgtgtccagcctgcagaatgttgtcagatcaatgcccatttcttcatctatataagaaaatgtctgggcaactggaatcggttcgctgatccctgttgattcaatgacaatataatcaaacctgccgtctttcgcgagtttctcaacttcgactaataaatcttcacgcagcgtgcagcagatacagccgttggataattctacaagtttctcatccgtccttgacaaaccgcctccctgcttcaccaagcccgcgtctatatttacttcgctcatgtcattgacgatgacggcaatttttaaaccgttgcggttttgtaaaatatgattcaaaacggtcgtctttccggcaccaagatagccgctcaatactgtaaccggaatttttttcatatcaatagccccctgataaaatagaatgattacgatttatatctcgcaactgccttattttcatcatgatgtacatagttttaaatcgcaatcgttactatttattttgatgtattctccgtttaaaatcaagtaaaagtcagacacatcacacgttgtttgtccccatccattggtctgacacgcaaaacgtcaacgatttaattggtgaagccttggatccggactgtaaaatgcccggttttaagatgtgtgcggtacgaatcatccctatctaattttcataaaatttttagattttttcgtattttttgttacatttcataacatgcatcttaaatatttgtttttgctgtgctacgctgaaaaaaacaaagataaggagcggatcatctgatgggaaaaaaacagctagtccttgttggaaatggaatggccggggtaagagcgattgaagaaatactgcgtgtttcaaaagacgaatttgagattacaatattcggggccgaacctcatcccaactataaccgaatccttctgtcaaaagtgctgcaaggcgataccgacattcaagacattacgttaaacgattggaactggtacaaagaaaacaacattcagctgtataccggtgaaacagtcatcaaagtcgacacggaaaaccaaaccgtcatcaccgatgcagacagaatccagccttacgatgaactcatcctggcgacaggctctgtcccttttatccttccgattccgggcgcagacaaacaaggcgtcacggcattccgagacataaaagataccgacacgatgctcgccgcgtcaaaacaatataaaaaagcagccgtcatcggcggaggactgctgggtttggaagccgcgcgcggactgctgaatctcggcatggacgtgtctgtcatccacctcgccccattcctgatggagcgccagcttgacgcagcggcgggacgcctgctgcaaaacgagttagaaaaacaaggcatgacatttttccttgaaaaacaaaccgaagaaattctcggtactgaccgtgtcgaaggcgtacgctttaaagacggcacaagcatcgaagctgatctggtcgtcatggcggtcggcatccgcccgaatacacagcttggcacagaaagcggcatcccggtaaaccgcggaatcattgtcaacgattatatgcagactgaaattccgcacatttacgcggtcggtgaatgtgccgagcaccgcggaatcgcgtacggtcttgtggcgccgctctatgaacaggcaaaagtgctggccaaacatatttgcggcattgaaacaaaaccgtacgaaggctccgttctctccactcaattaaaggtatcaggcgtcgaggtcttctctgccggcgactttgatgaatcagaggacaaaaaggcaataaaagtgttcgatgaacaggacggcatttataaaaaaatcgtcctgaggggcaatcaaattgtcggcgctgttttgttcggagacagcagcgaaggcaaccgcctgttttctatgattcaaaaagaagcagatatctctgaaacctccaaaatatcaatcttacagcctcttgatcaggaagcaggcgtaagcatgaccgcggcgatgagcgacgatgaaatcatctgcggctgcaacggcgtttcaaaaggtgccattattcaagccattcaggaaaaaggctgcacatcaacggacgaaatcaaagcatgcaccggggcatcccgttcctgcggaggctgtaaaccgctcgtagaagacattcttcaatatacactgggctcagaatttgactcatccgcgcaaaaagaagcgatttgcggctgcacctcactgtcgagagatgaagtcgtagaagaaatcaaagccaaagggctctcacatacgagagaaatcatgaacgtgctcggctggaaaacgccggaaggctgctccaaatgccggcctgccctcaactactacttaggcatgattaatccggctacatacgaggatgacagaacatcccgttttgtgaacgaacggatgcacgccaatattcaaaaagacggaacatactcagtcgttccccggatgtacgggggcgtaaccaactctcaagatctccgcaagatcgccgatgtcgtcgacaaatatgagatcccgctcgttaaaatgaccggcggccagcgaattgatctcatcggcgttaaaaaagaagatctgccgaaagtatgggccgagcttgatatgccgtcaggctacgcgtacggaaaaacactccgcacggtaaaaacgtgcgtaggcgaacaattctgccgcttcggcacacaagactccatggcactgggtattgcgcttgagaaaaaattcgaagggctcaatacgcctcataaggttaaaatggccgtgtccgcctgcccgcggaactgtgcggaatcaggcattaaggaccttggcgttgtcggcatcgacggaggctgggagctttatgtcggcggaaacggcggaacccatttgcgcgccggtgatttgctgatgaaagtaaaaacgaatgaagaagtcttagaatacgcgggtgcttaccttcagtactacagagaaacggcaaactatctggagcggacatccgcatggcttgagcgcgtcggtttatctcatgtccaatccgtattaaacgatccggaaaaacggcaggagctcaacgacagaatgaatgagacactctctgtccacaaagatccgtggcaatacttccttaaagataaaaaagcttctaaagatctattcgaaaatgtcgtcacgacttcataaaacagtaagggggaacggacatggttaataaagatatgacaaaggtttgcataggcaatgtaaacgaattacccgaggagttaggaaaaaccgtatatatagaagataaagagcttgccgtatttaagctttctgacgggagcgtccgcgccgtcgaaaaccgctgtccccataaagagggcgtcctggctgaaggcatcgtcagcggagaatacgtcttctgcccgatgcatgactggaaaatttccttagaagacggaaaagtccaagagccggatcatggctgtgtcaaaacatacgaaacactgatcgaaggagagaatgtatacctcctgtattgatcaaagaccggatcacttttccaagtggtccttcattttttaaattgctgaagggatgacgccatcatgaaaaacggaatcgtatactttgtcggtgccggaccaggagacccggggctgatcaccgtaaaaggaaaacaggctctggagaaagcggatatcattttgtatgaccggctcgcaaacccaaagtttctagaatacgcctcaccggactgccggttcatttattgcggaaagctgcccgaccgccattttatgaaacagtctgagataaatgccctgctgatagaaaaagcggcggagggctacaccgtcgtccgcttgaaaggcggagacccaagtgtgttcggcagggtcggcgaagaggcagaggcgcttcatcagcacggcatccgctacgaaatggtgcccggcatcacctcgggaattgcagcgccgctgtatgcgggagtccccgtcacccatcgtgatttcgcttcgtccttcgcgatgatcaccgctcatgatacatcattgcacggcaggccgaatctcgactgggaagggcttgcccgaagcgttcaaacgcttgtgttttacatgggcgttaaaaatctgtcatttatatgcaggaagcttatggagtacggaaaatccccttccgttcccgtactcgtcattcaatgggggacgtggggacggcagcggagcgttaaaggaacgcttcaggatatccatgaaaaagttcaaagccaaaacatcaccaaccctgccattatcgtcatcggtgatattgtcaattttcaaacacacagctggtttgaaagcaaaccgttcatcggacggcatatcatggtggtcactcatggggatgatgaacatacattgacagacaagctgcgcgagtatggcgccgatgttattgaatggccgaagcggatcgttaaaaaaatgcccgcaaacgaaaacatcctgaaacagatcagcacctttgaacaactatttttcacatcacgccttgcggtatgcgaattctttgacacactggctttcaagcagatcgacatccgccgggtgaccgcaagcctgaatgcagcgactgaagccgcaaagacggaactgacaaaacggggctttctcctatccgaatggcaaaatgattctccgcattctctcattgtagggagccgtcaagcagcagaaaacttgccagactcaaaatcatgcctgttttatatcacccatgaacatatcgcggatgagcgattcacttccatgatcgaacgcacgatcagtgagtcacctctgcaaatgattatctgtacgggcaaagaatccgctcagcatttgatcagcgccggaaaacaaatcggcatatcaccgaacccgagaggaaaccgccctcccgtcatctgcatgggcgaagacctccccgccggctgcgggtttaccgccgtgaaaaatcaggaacagttatttgcgtttatacgaaatgaaatgaaagacatgctcgttcacagctgatacgccggaatgcttttctgacccccggacccagcatcggggggcagcccttttttattgtgtcaccaattttttatgatgagtcgaatacatcgccatctgatccgcatgcgggtccaaataggctttggcgctgttcactgcggtcggcccctccgtgaaaccgccggcaatcagtctgagcttgctttcataatgggcggcgtcaccggcgacaaacacgcccggaagattcgtgcgcatatgcctgtcagctttaatcctgccttcttctatctcaagcccccagtccttcatcggaccgagatcaattttaaacccgtggttgataatgagctcatcaagcttgatgacttcagaaagtccggactcagtttggcaaacggtgacgctctcgatccgttccccggtgccgttgagatgcttcagacgatacggcgcaagcacccgcacggaagaccgcttcattttcgccacgctgctttccaaaccgccaaactcctcacggcggtgcaagacggtaacagacgccgcaatcggttccagctcattcgcccagtcaaccgcggtatctccccctccggaaatcacgacatgcttatctcgaaacgcatcaagcttctccaccttataatgaaggttctttcctgaataacggctcgcatccgcgctgtcaagttcattgacctcaagcgtccccatgccgacggccaaaatcaccgtgcgcgtatagtgcttttccccttcggaactttcgagcacaatggttccgtcttccagccgttcaaatccggccacccgctgattcaacacgatatccggctcaaatgtcgccgcctgctccttcagctgcttaatcagctgttccccggcaatcccgggtattccgccgatatcacggatgattttttcaggaaaaaacatagacacctttcccccgagccgcggcaaaaactcgatcactttcgttttcagctcccgcatcccgcaataaaaagccgcaaacaggccgatcgggcctccgcctataatcgtgacgtcgtacacctcatgattttccgccatcgttctgcctcccgtttatatctatacttcatacttttttaattgagaatcaatatcaatgaaagtataacatatattgaggagcagtgtttattcatttctcatcttgcgggaaaggagtgattcagaagtgaggttctgagattgataagcgggaaggtattaaaactgaaaccagtacggcgactggtttcttttttatctctttttcatcagcatgatatcgagatacagctggcaccttgtcctgaagtcgtttaaattaattgatgtcatgtcaagaatctgtttgatgcggtagttcaatgtgttttgatgaataaaaagctgttctgcggctggttttgttttgcagttattgaggagatagatttctaacgttttcagcagttcggtgctgctttctctgtctttggcttttaataacgctaaatcatcgtttacatattccagtgaggcgtttttttcttcgatgctttcaagatagcggtaaatcccgagcttactgtattcgtacgggatattttcctggtttccggtaatttcggcggcctttataacttcaagggcttctatataacttttgccgagcttcaggatgctgctgtattcattgccgattccgatatagatgggagtggggatcttctgaaagtgaaaatgagtcagcagtttgtggatgaattcagatgctgccgaagtgccggagcttttttgcgagaagcttgcgacgacgatgacaatattggaatcaatggttaagacgtggctgactttatcccgcaaattcaagtacgatttgatattttcctttacatcttcgactgcctccccatccccatttgcggcgtgcaggacgactaccgaaaaaaccgacggcagcacggcgttcatcttttccgcttcccgcctgaactccttttcagaggagaattgctgaaagatcgcccgtttcaccaggtcttccgctctctcttctttttcctgtttcagccggttcgttttgtagatgatttttccgacatggaatgaagtttcatataaaaaatcgagctcctcgtccgtcaagtttcggtcgagctcctgaatccagatgtagcccatcacttcccctttatgttttgcgcttacaaccactctctgattcaatccgatactgtctattttttcgacacggaacggttcaggaacggttttcagcttttcgatcaccccgtccttcagaaacctttcaaaaatctgcacggggcatttttttgagaatatcgtctgctggttggcggagtcgaagtgattaatgtaataagaattataggcaagcaaaaagaaatccgcgctttccagaataacgggcttctgcaattcataactgatgaaatcaattaatttatcaatgtccgtaaatgaaaaaactctctctaaaagctcttccatacctatttctcctatgctctttttatctttatcatactctgaggggtgactttttgtatagaaaaaaattcatatactcccaaaacggaatgatccgaaagcctgtatcgtgaaaagaggaaaaagggcggtcccttcttcctctcgttccttgcttttattgagaaagtgtatcacggtagtcatgaaactgatctgtgacatcttttgacggagcctgtgtcaataagctgacaacaaatacagcggcaaggcttacagcaaagcccggaatgatttcgtacaaaaagtctgaaagactggcattcgcccaaatgattacggtaatcgctcccgcaatcatgccggcgagtgccccccatttcgtcatccgtttccaaaataaactgagcagtacgaccggcccgaatgaagcgccgaatcccgcccatgcatagctgacaagaccaagtatcgtgttgtttttctcccaggcgagcaccaaagcgatgattgacaccgcaagcactgccattctccccagaaatacgagttccttatcagaagctgaacgcctgaacatggacttatacaaatcctctactaaagaactggacgtaacgagcagctgagacgaaatcgtactcataatggccgctaaaatcgcagaaatgagaaatcccgtaataatcgggtggaacagaatgttgccgagctgaataaaaatggtttccggatcagccagcttcaacccgcgctggtggtaatacgcgattcccgcaagacccgtaaacagcgcgccgagtgcagacaaaatcatccatcccattccgatccgtctggcgcgtttgatctctttcacagatgtgatcgccataaaacgcacaataatatgcggctgcccgaaatagccgagcccccacgcaaataaagaaataatgccgaggacggtcgtccctttgaacatattaaacagttccgggttgacggaacggatatcggcaacggtttcccccgggccgcccgtatggaaaatcgtcacaatcggcacaagaataagcgccgcaaacataatgatcccttgaacaaagtccgtccagcttaccgccaaaaagcccccgaacaaggtgtaggcgacaacgacgcctgtcacgacccacagtcccgtgtggtaattcaaccctaaaatgctgttgaataagacacctccggacaccatgccggatgatacgtaaaaagtgaaaaagacgagaatgacgagacccgaaaacagtctgagaagcttcgtatgatcaccgaaacggttttcaaggaaacccggaatggtgatggaattccccgctttttcggtatacgttctcagtctcggcgcgacgaaaagccagttcgcccacgccccgagcacaagtccgatcacaatccaagcgccgcttaatcccgttgagaacatggcgcccggaagccccatcaagagccatccgctcatatccgccgcccccgcgctgagcgctgtgacggcagggcctaaagaacgccccccgagcatgtaatccgtcagatttgacgtccgtctgtaggcaaaataaccgataaacagcatgcccgccatataaatacaaatggaaataatcaactgaatgtttgctatggcatttcctcctccgctttatatgtttatggtgaaatggacacccccgcgaggaggatgcccattcagtccctcttaaaacatttcactgattgttttcgcctgcatgtgaagggccaaataatccgggccgcccgcttttgaatcagtgccggacattttgaagcctccgaacggatggtagccgacaatcgctcccgtacaattgcggttgaagtacaggttgccgacatggaattcctgtttcgcccgttcaatatgtttgcggttatttgtaatgaccgcgcctgtcaaaccgtattcagtattgttggccacttccagtgcttcatcaaagtttgatactttagaaaacgccacgaccggcccgaaaatttcttcctgcatgagtctggctttcggatcaaggtcagcgaagatcgtcggcttgataaagtagccttttgaatcatctccggtgccgccgcttactaaacggccttcttcttttccgatttcaatgtagctcatgatcttgtcgtaagaaccttggtcgatgacaggtcccatatacacgtcagcgctgtcagggcttgccgtcacttttgattcagtgatttcgatgacgcgctctaatacttgatcatacactttttcatggacaactgcacgtgaacctgcagaacatttttgtccagcgaagccgaatgctgatgtaaagatggattgagccgccaattcaatgtccgcgtcctcatcgacaacaaccgtatctttaccgcccatttcagcgataacacgctttaagtgctgctggcccggctgcactttcgccgcgcgttcgaaaattctcgtaccgacttcacgtgatcccgtaaacgtaatgatgcttgttttcgggtgatcgacgagatagtctcccacttccgctccgcttcccggcacaaagttgacaacgcccttcggaagacctgattcctcaagcacttctacgaacttcgccgcgatgaccggtgtcgcgcttgccggtttaagaacgaccgtgttgcccgttacgatcggtgccaccgtcgttcccgccataatcgcaaagaggaagttccatggcggaatgacgaccgttacgccggtcggtgtgtagacatattggttcttctcgccttcgcggctgttgaccggcttgccttttgccaattcaaccatctggcgcgcgtagtattccataaagtcgatggcttccgccgtatccgcatcagcttcattccaaggctttccggcttccttgacgagcagggcggagaattcgtgctttctgcggcggactttggcagccgcgcggaacaaaacggcagctctttcttcaggggatgtgtatctccactcttcgaacgctttcgcagccgcttcaatcgcctgctcagcgtgctcctgggacgcctttgacacttttccgacgacttcttctttgtctgcagggttaatggatacgattttcgcttccgtctctaccttttcaccgttgatgacgagcggataatcttttcccagatactcatttaccgtcgcaagcgctttcttaaattcttcaacgttcgattgatcttggaaattcgtgaatggttcgtgtttataaggtgtagtcattgtcatctctcccttttttacttcttagtcattcctttaaaggcgaatgcgatgtttgaggggcgctcggcgagccgtctcatgaaatagccgtaccagtcatccccgtaaggcaggtagactctcatacggtatccttcttccaccaggctgagctgggtttgcgagcgcatgccgtacagcatctgaaactcaaaacggtcgtttggaatgccgtgctcttcggcaagctgttttgtaaactcgatcattttgtcatcatgcgtggcaactgccgtataatgtccttttaaaagctgtttgcggatgagtcttttataattttcatcgacgtcgcttttttcaggataggccaccttttccgattctttataggcccctttgacaagccgcagaaacggattcagcgggctgaggtcatcaagatccttctccgttctgtacagataagcctgcaccacggtgcttacatattcataccggctccggaagtctttaaagatatccagcgttttctggcatctcgtttcatcttccatgtcaatcgtcaccatgactttatgtttttcagccgtctggaggattttcgtcatattttcatagacgagatcaagatctatatcaagacctaaagacgtcatttttaatgacacttgggaattcagctgttcatcagcaattaaggcgatggtctgcatgcactcctcggtgcgttctttcgcaacgtcaccgttgttgacaaattcccccaaatgatcgacagtaactgacagcccctggctgttcaaatgtcggattgtcgggatagaactgcggaaatccattcctccgatgattttgccggctgccacacggcttccccagcttcgcgccatcttattgagaaagctgctcttggataaaaataagaaaaaatctcttgtaatcacttccaaccttaacaccccgcaatctaagaagtatttgtatgagtctattgtaaatggacaaaacatcctctcacaatattctaaaaatacaaagattctgataaatttttgtggttttaccacaatcagcttcttagatagcaggcggattatgccgaaaaaaggcggacggaaatgacggcaatcgtcaatttccgcctttttccccccacgcctcttcgacggtctgaatcaatagctgattcagttcctccgttatgtcaggtttcggtgttttgatcgttttgacatagtgcccgatgcgttctatttcttcttctataaacgcgtgaatgatcatatttctcggttccggagccagctcctgaccgctttttttccttgtaagcagtgtattgatttcagaaatgagcgcttcatccgtcaataaggcatcggccagtacgggaaatgacatcggcggtacggagccgaacgtttcaatccatctgcaggcaaggagaggacgcaaaacataaaaatactttttaatcttcacttcactgccctgcaattccgttttttcattccgttttgccatattgagataatgataaatgccggcttcaggcgaaaaggcgcggattttcagttttcgaagcttttcagccgctgagaaagcttcataatagatcatctcagaagagagccattccaaaagaggcggatttgattttttaaaaagccgcagcgcttttctcagttcccagccgctgatgtcaagcatgtcatgaatcggctcttctatgacatccctatgcggttcgatcgaaaagtaccattcttttttcggcacatagagaaaccgcacatcgtagtcgctgtcgcttgacggaaatccccatgcgcggctccctgattctacggcgtaaagcaccttgacgccgtgctgtgcttcaattcgttttaattcttcgatgatcctttgttccatctgtatccgtccttttccgtgatcattcctgaaaaaagcccaagtacttgggcttttcgctgtcgtcagcctttcagatgcgctttcagaaaggccagcttttccttatggaaagaaggtatgtattcatgtccgaaataccggtaaaccttcaattctttttccgtttccagatgattgtaagcggcaaacaccgtcgacggcggagtcacgcggtcaatcagcccgatagacatgagcaccggaacttttacgcggtccgccagattcatgatatcaaaataggccagtgtattcatcgcggccttctccgtctcagggctgccgttctttctgaaaaaagagttaatctcaagatacggctcatcaagagcgacatcaatggcccgctcaaaattgcttaaataaggataatcggccgcaaccgctctcggaatgtcagatagtgccgccgcggcgattgaaagtccgcctccctggctccccccgatgacggcgattctcgtctcatccacttcatcaaagccgctgatgacttccaaagcccggacggcgtctaagtacacgccgcggtaataatatgtatctttatctaaaatccctttcgtcatccagccgggaacgtgtccgtgcggtgagacgcttgtatctgtgctgctgtgctggccgcggacaagcatgccgaacgcggcatatccgtgaagcgcccaatttacgatgtcatgtatatctccgtcataactcgcgttgtagccgtgatatttcacgatggccggatgcggtccttgccggtcgggaacggcgtaccatccctcaatttccgccttgccgaagcttcggtatgtcagccggaatactttcacgccgtcagccgggtagctttcagccgtcaattcaggctttgcctcttcctttgcaagctcatgtaatgatgatgcccaaaaatccgaaaagtcatgaggagcggttttatttggtttataggtttgcagttggtcgagcggcaagtcgtataattgcatatccgattattctcctttgttttataagatttaattttctgactctatcttaacacgattttacactcattttctaaacattttaataaacgtttgtttaaaagaaaacaaaaaagccgtacgctcacagcgtcacggctctttttacatcggctgatacagatcccagccgatttttaacgtttctacgatataatcggcgatttcttctggttccagattatccgtcgccacttttgaattatgtttatcatagatgctttggcgctcgttaaagagctgctgcatttcatccatggaacggttatgcagaacgggacggctttcaatcagcaggtcagcccgctgcttccaattctcccatgataaatcaagatggagcacgagacagttttcgaggcagcactgtctgattgcctcttgtttaaacgaaccgcccccaagcgacacgatcttgaatttcgtattgcggcagatatctaatatatagtccttttcagtttgacggaaaaaggcttcaccttttttctcaaacatttcagggatggacatattgaaatctttctcaatctgcaaatcaatatcaatgaagtctctgtataatttcttagcgaccagctggccgattgttgtctttccgacacccatgaatccgatcagtacgatgtttctttctcttacgggaatggcacgttttgcgttcatcttcggcgaaatcctcctaagaaatgaaaaagttatgtttattatatgataacccaatattgaaatatagagataatgcaataaaagaaaacccatcctttataagaagagatgagtttttctttctatcggagcgtaatgcgttccacctttccgacaatgaaaatataagaaaatgccccgataaatgcgacagcgccgacaaacagaatcgctccgttatatgaaccggtcgcagaaacgataaacccgatgataagcggggtgataatgccggccatattggcgaaaaagttaaacacgcctcctgccaatccgattgtttcgcttggcgccacctcactcagcatcgtccaggatatattggacatgccctgcgcaaaagaagcaatggataagatcgtcaaaaccgcaggagcagaatccgtaacattcgcgagcacgatggagcctgtcagcagaagaccgaggatgacgggggttttccgggcaacgttcaccgacacgccccgtttcatcattccgtcagaccaatatccgccgaacaatacgccgaaaaaggcggcgatatacgggattgatgcggcgaagccgacttttaagaatgccatgtgctttgcctccgccagataagtcggaaaccatgtcaaaaagaagaacagcgtggaggctacggcgaattggccgatatacaagccgacaagcttgcggtatttaagaagctggacgaaatcccgccacgtgatcctgccggctgattcagacacctctgtcagtccgccgccttctctaatataatcaagctcttcccggttcactttccggtaccgattcggctcgtgatacattttgaaccagaaaacggagaaaacaagcccgagcacccctgaggaaataaagacggcgcgccagtcaaatgccgttaacacccagaataaaaccggtgtggcgaacgccagtcccacatattcccccgccgtataaacacccgtggcaaaggcgcgttcccgccttggaaaccatgtcgtgacaatccgattgtttgccggaaacgcaggcgattcagccagcccgataatcaggcggcagccgaataaaaatccgaaactggctgcaaaagcctgcactccggtgaaaacagaccagatcattaaagaaacgccgtacgtccgttttgacccgaatttgtccaaaatgagcccgccgggaatctgcatacccgtataggtccagctgaatgcggaaaagacgacgcccaaaagcgcggggcttatgttcagcgatgtctgaatggacggggcggcgatggatacactggcacggtctatataattaatcgcagtgataaaaaacaaaagaaacagtatcacataacgagcgcgagtcggtttattgcggacgggactgaagtccgtcagctccgtttcatttttcaatggcttctccccccttactcgaatgaaattaattgtacaacacttcggtcaattatttaatactttgacgcaaaaaagcgctaaacaatttgtgcgccgcactgacactccgcttataaaagtgtctgcccttttcacctgtttatccgtatctcacccggggaaaagtacacatatgatagacagttacgggaggattaccgatgaaactgagtttttgcacgacaggatttaaaaaaaagcatattttcgacatcatttctttcgcgaaggagcactcctttgacggaatcgaactgtggtacggacacgctaaacaatatatagaggaaatcggcccgctcgacaggcttgatcagcagcttcaggaggaaggcctcggggtgcctgccgtcagtttgtacactgacttcgccgctcaggatgaaaggcaggcgttaaaggatgttcaaggggcattaagcgcggcacgacagctgcacagccccttgatcagagtctttgccggcaatcttccttcgcatcggacgtcaccggaaaagtggcaacgtgcggttgatcaatttcagcaggcggcacggctcgcagatgactatgaagtcgatatcgggcttgagattcattacgatacgtacgcggatacaccggaggcggcactggcatttttggaggatgtcggacatccgcgggtccgcaccatttttgacggctccaacctacacgtcaatcacgttgaccaaatgtccgctttagaaaagctgtatcataccgtcagccatattcatctgaaaaactatcactggaattttgacaactggtatctcagcaagccaactccgattttccaaggagatctcgatcaaaaagcatttttaaaagagctgatgaacagacaatatgacggttttgtttctcttgagtattttggagaacatgcctttacgcatataaaggaatcgctccgggaatatacgtctgttttttcccgctgactcttcgatcgaagggtcttttttttgtatcatatagaaaaagggggatatcatgatgatcatttggataaatggggctttcggttccggaaaaacacaaacagcgtttgaactgcacagaagactgaaaccgtcttacgtatatgatcctgaaaagatggggtttgcgatgcgttcgatgataccgccggatatcgctgaagatgactttcaaagctaccctctgtggcgggaattcaattacagcatgctttcctatttgtcagatacatatcagggcatcatcattgtgcccatgaccattacgaacgatcaatacttccatgacattatcagcaggctgagacaggatggccggaccattcaccactttaccctgctggcttcaaaggaaacattgctgaaacgcctgcgcaccagagcggaaggaaaaaactcctgggccgcaaaacaaatcgaccgctgtatcaacagcctgtctgatagcctcttcgcagaacatctccatacagaccaaatgtctattcagcaggccgcagaaacgatcgctgcccaagcaaatctgcctcttgagcctgattcgagaggcagccttcgaagatttaccgacaaattaatggtgaagctgaatcatatccgtatcaaataaaaaagcgttttgaaaacatgtccctgacccatgcaaatggatcaataaataaaaagtccctccgaagggatgtttttttcaatttaagaaaaaaattttagaaataaaggaggaattatatggataatcgtctaattattaacactgtaatacatttcatttgaaaagggagtgttcgaaatgaaattcaaaaaagtgttaaccggttctgcgctgtctcttgccttactgatgtctgccgctcctgcctttgccgcatcaccaacagcatccccatccgtggaaaatagcccaatctcaacgaaagcagatgccggcattaatgccatcaagcccgttccaagccctaacggtattttcgctgcttctttcgaactgaatggtacaacatggatttttaaatacaaatactatgacagcagcaaagggtattgggtagggatttatgaaagtgtagataaataaaaatgaaataaacaaaaaacctccctttcaaaagggaggtttttttcattctatttccaccaatcatcaaacatcgatgccggcacctggcgcttgtgctccgtactgaggtagcgtttttccagcgcttcaatcacttcggaagaaacatccttgccttctaaataatcatcaatgtcattgtatgtgatgccgagctcggtctcatccgtctgctgcggtttttcatcgagcagatcggccgtcggtaatttcaaatacaggcgttccggcgcgccgagttcttctaataaacgtctgccctggcgtttcgttaatccggtcagcggcagcagatcagctccgccgtcaccgtatttcgtgaagaaaccggtcaccgcctcggccgcatggtcggttccgatgacaagcagcccctcttgtccgccgatggcatattgagcgatcattctcattctggcttttacatttcctttgttaaagtcagacagctgatcgcccgtgtcttttttatactgatcagcgaacgcgctgacagcggacttaatatcaaatgtccatgatttatcaggtttaatgaatttgagcgccaattgggcgtcatcctcatcttgctgtgtgccgtgcggaaggcggacggcgataaattcagcgtttccgccttcttctctgatgctttcagccgccaattgggcgaggcgtcccgcaagcgtggaatcctgcccccgctgatgccgagaacaaagcctttggcacctgtttttttcaaatattgtttcagaaagttcactctgtcctcaatttcttgtttcggatcaattgagggttttacatgaagatcattcataatttgtttctggatgctcatcccaatcactcctcctgcattgtttctttatgattcatttcccgttcatactgaaaatgaatcatgccactatgtacgactctttgttaaatatagcacaggtgcagtttttaagtgaaccaaatacaccgggatcagctgatttccacccgcagcgccgtgatgctgtccccgttgcatttccctttttcgatcggacaggatgaaaacgcgacgacgagatccatttccgcacggagccgtacataatcacccgcgtcagaaagaggggtttcgactgataagttccccttctcatcgagcaccgtgttcataaagatggcaaatgggtaatgcatatgcggccgcggcaccccgaacggttcaagcgccccgctcatattgtcatagcacgtatcctggagctcgtccttatgctttccgtataaaagcctgttcatatccggacggcaggcgggaagcagcaagtcgtgcttgccgactgtatcctcaatcagcgtcagcatcggcttgtataaatttgaataaatatgatcacctgtttttacatgaatggactggttggcatcgatcgtcgcgccctgatcaagatgttcataaaagtccttggcatgatacgccgtaaaatcagccacctgctgcccttccacatcgactacttttataatctgccctttgtgaaccttcaggccgagcccttttttcggcggtacgataaattgctgtgtcatcagactgctcctttttttcttctattatgaaccccggccgtttgtttcatgtaaagcaatttattggatgtatattccccttctgacggccgcaatctaagctttgataaaggggttgaacttcatgagtaaatcacaggaccagcctaaagggaatctcgcttggtggcagctctccttaatcggtgtcggctgcacaatcgggacgggcttttttctcgggtccagcatcgctattgtcaaaagcggatattccgcgctgatctcatttcttattgccgggcttggcacctattttgtctttgagcagctcgcgaagctctcggccaaacagcccgaaaaggggtctttttgcgcttatgcgagaaaggctttcggcacttgggccggtttcagcaacggatgggtgtactggtcgtccgagatgctgatcacgggaagccagctgacagcgatctcgctgtttacgaagcattggtttccgaatgtgccgctgtggattttcgcctccatctatgcggtgctcggtcttttgattatatttacggggctgtccgtttttcaaaaaacggaaaatgtgctcgctgttgtcaagacggcggcgattgttatgtttatcgtcatcgccatattggcgctgtgcggtatattttctcataaaccggatgtgcaggtgccgaacgaatcaaaggatttgttcccgcacggagcgatggggttatggacgggattgatttatgcgttttacgccttcggaggaattgaagtcttggggctgatgaccgtgcatttgaaaaagccggaggaagcctcaaaatcaggccggctgatgcttgccgttcttgcggtgatttacgtcatttctctcggcctggcgctgctgttagtgccgctgggcaaattcaccgaacaggacagcccgtttattacatcgctgaagggttttcatttagatatcattcttgatatttttaacgggatttttattattgcgggattttccacgctcgtcgcctcgctgtttgcggtgacgacattgctttgtacaatggctgatgacggagatgcgccgaaatgcttcagattaaaggaaaacaaaaaaatctgctggcccgcgctcggattgacgtttgccggactcatcgtctccatcatcctgtcattggtgctgccgaaaaacatatatgaacacatgacaaccgcggcgggcctcatgcttctttatacgtggctgttcattttgttctcgggcaagaaactgcttgaaacgacaaagatgggaaccgtacagattgttatcgcccttgtgctgattgtcgcggccgtctccgggacgctgtttgagaaatcgagccggcccggttttctggtcagcctttgttttctcgccgtcattgcgatcgtgacatggatcgtacaaaaaaagcagggacacagccctgccggatcatagcttatttcgtcggtttaaacagtctcttcaaataagaaaagggacactttgacacttgggtctcatcatcacggaggaaatattgcttccattctaaattgtcttttcctccgtaccaccccaatcggggatgaagaggggcttcatcatacgcctctaagcgttttctgatcagccggctcatgtttcgtccgaacgcggttgaatcatttaatccttcaaaaacccatctcggctgaaacgccagcataaaaaacgggaagcttctgctttgtctcgcttcatgcgcaggcgtcgcgcacagaataaaatacggctcgccgtcaaagcagaactcccatttataatgttcagggtcttccggtatgtcttccggccagtctttcgggtcgcagccgctcagccggtttaaaaaagaccagaacagctcttcatacgcctcaacggaataatgctcagctaaatcctcaggcgtatcaaaaatcacaagcagcgacgcgtattttccggtattccttgagatctttccgtactcggacagcagcatccccacttcctccggggttccctcttcgcggggatcacccgcaaaggatatccggagctgatctgtcaaaaatccctgacgtccgggaatgcacggaaacgtatccgctttatcgcctactttttctgatagaagctcaaaagcgattctctgccaatttggcagatccaataacttttcctcaaggcaactttttgtgtacagcccgcttgccatcggcccacctccagtatcgtcaggatacgttatgatggagacaggcgataggtgacagtccttctatttatgagatgagcatttgaatcccctgccagccgaaataaaatccgaaaacgatcaaagacacacccgccgctcccgtcagccagcgaagcgctgtttcatgaagaagatttctgaaagtgctcgcagcgaccgccatgcagaaatcccagatcaaaatgccgagaagaatgccggagctgtaaatcaaaagctgatttgcatcgaaggattcagcggttttggcgagaatgctcccgtatatgccgagccagaataaaatgctcagcggattggaaagagaaataaaaaaccccgcgccgaaagttttgtaaaaagccggttttccttttccgcttctgacattcatggcttcccttatattttttaacgtttcgactcccgtgtaggtcagcacgaaaaaaccgaagagccacaaaaacgtttttacaaaaggagcggtcaaaaattgagacagcccgaaatagatcaaaatcatatacagcccgtccgcggccatggcgccgagaccgaaaatccatgcatgccaaaagccgtttttgatgcctttgtcaatttgcgccgcattgaccgggccgacaggtgctgacaatgacagcccgagaacgatgtagcttaaaaagatgttcattggcttccccctcattcatgcaacttgtacaagttattcatgaatgggccgtgctatgatacattattttaatttctcaagctcgtcttccatcatgtccgtcgcttttcctaaaaaatcgaatatcagccgcagttcttcttctttatattgccggcaaaggctgatcgtggactgggataaggagctgaataattgcttcacattcgcttttccggctgtcagcggcacgatgatcacccgccgtttgtcttcggggtcttttttcctcatgacatatcccgctttttcgagccggtcaatgagcgccgttaccgaacctgtgctgaggccggtttttttcccgagctcgcctgcggtcatcgggcctgcttcatttaagatatcagctgatttcaaatcggtcggaaacagaccgagagattgagcggccgcctgatgaaacaggatcgtccttgtggccatcttccggaataactgtatggcggtttcctccgtctcgcttctggtatttcttgttgacaactgacaggcctccctataaaatcaatttatcttgacgatcaagataattttcggcaaatctaatatgatcatagcaaatttaatgatcaaaagtaagtatgggaggaaaaagcatggaacaaacagccgcgaaggacgcctcgacgaagtttgtcgtcatcggtcttttgctgggcattttaatgtcggctatggataatacaatcgttgccactgcgatgggaaatatcgtggcggacctcggaagtttcgataagttcgcgtgggtgacggcatcatacatggtagccgttatggccggtatgccgatttacggaaaactgtccgatatgtacggacgcaagcgtttctttttattcggtcttattcttttcttaatcggatctgcattatgcggaatcgctcaaacaatggatcagctcattatttaccgcgtcattcagggaatcggcggaggtgcgctgatgccgatcgccttcacgatcatttttgatttatttccgccggaaaaacgcggaaaaatgtcgggcatgttcggtgccgttttcggcctttccagcgttctcgggccgcttttaggcgcgctcattaccgactccatcagctggcactgggtgttttatatcaacgtgccgatcggtattttatcattgtttttcattcttcgttattataaagaatcccttgaacacaagaagcagaaaatcgactgggccggcgcgattacgctggtggtttccattgtcggtctgatgttcgctcttgagctcggcggaaaaacgtatgattggaactccgttcagatcatcggtctgttcgctgtgttcgccgtgttctttatcgccttttttatcgtggaaagaaaagcggaagaaccgattatctcattttggatgtttaaaaaccgtttatttgccacggcacagattctggcgttcctttacggagccacatttgtgattttagcggtatttatcccgattttcgttcaggctgtgtacggcagcaccgcgacgagcgcgggctttattttgacaccgatgatgatcggttctgttatcggaagtatgatcggcggaattttccagacgaaagtgcggttccgtaatttgatgctgatttccgtggtcgctttctttatcggaatgctgctgctttccaatatgactccggatacggcgcgtacgatgctgacggtattcatgctgatctcaggattcggcgtcggcttcaacttctcactgctgccggctgcgtccatgaacgatctggagccgcgttaccgcggaagcgccaactcaacaaactcgtttttgagatcattcggtatgacgctcggtgtgacgattttcgggaccatccagacgaatgtgtttaccaacaagctcacagattcattcagcggcatgaaaggagcgggcggcgcgatgcagaacatcggaaatccgcaggagattttccaggccggcacgcgcgcccatattccgccgcacattctggatcgcattattgacgccatgtcgcaaagcatcacatatgtattcacgcttgcgctggcgccgatcgtcattgcggccgttaccattttgtttatgggaaaagcgagagtaaaaacctctcaggaaatggcgaaaaaagcgaattaaaaaaagcagtacatggcgtttgtcatgtactgcttttttgtttactccgcgaaatgcggagcgagaatgtctttcagcacgtttgcgctatggttgaattgacgctgttctgtttcattcagctcaagttccgtcacaccggcgatgccgttccgattgacgacagccggaatgccgataaagacgtcgtttacaccgtattgcccgtccagatatgtgctgacggttaaaatactgttttcattacgcaaaatcgcttttgtgatgcgggcgaggctcatcgccactccgtaatatgtcgcgccttttttctcgataatatggtaggcggcgtttttcacatcgtccacgatctgatccagctcgtcctgtttgtaagctgcatttttctccagcaattgctgcaccggcactccgccgatattggcgtgactccatacaggaagctcggtatcgccgtgctcgccgataatgtgggcgtgtacgttttgcggagcggcgccgaaatattcactcagcatataacggaatcgcgcagaatccagtgtcgtgccgctgccgatgacgcgttctttcggcagaccgctgaatgtccatgtcgcataagtgagaatgtcgaccgggtttgtggcaacgaggaagatgccgtcaaatccgcttgccattacttcaccgacaatgcttttaaaaatggcgagatttttttcgaccagctcaagtctcgtttcgcccggtttttgattggctccggcacagatgcatacgatatcggcatccttgcaatcttcatatgttccgtaagacgttttcaccggatgaggtgcaaatgcctttccgtgatttaaatccatgacatcgcccatggctttttctctatttacatcaatgatcacaagctcatctgtgatcccttggttaattaacgcaaatgcataactgcttccaacaaaacctgctccgattaatgctactttgttcactcgttcgttcatcatgtatgctcatcctccagtgtttcgtggtgtctgtttttaacttgtgaagtatttcacatttatattgtgcaacacttcacaaacttttgcaagagaaaagtttgatttttggacaaaaaatatcgatgatggtttccagattgttgacaacatcctaaaacggaaccgttttaggatgttgtatcttttcagcgtgattgaagacgtgctgtccttttcccagaagcgagggtttgccggcacgctgatgtgatgatagccctatccattaatgcggaagataaccgtttaaaccggagttgttatacaaaccattctgcacataatcaaatccgggctggttctgcccgggcacttgggcgctgccattgttaaaaatcactttggcattggccgtatccgcattcgcaggcagcgtcagcgtgtaaattccatttgcattcttagtcattgctttccccggccacgatccggttaattctatggccctgcctccatcatgtttgtaaatataagcatttacctggccccaatgatccggattttgatagccaatgatgttggtttgggcctggtcttttttgacaaacgtgtattcttgagttctctctgcaccctcgccgttcgttccggttaacctgatgttgtatgtcgtgccgattggatctcctttcccgatcgttaatcggtctccatccttaaatgctgtctgctgcccattattgatttggtaaacggcttttgctgttttcgcatttgcacgcagggtgaccgtcagctgatcattgaaagaatggactgcccccgtttggtaattctcaagaaagacatgaggcgcatttccaatatcatcagaataaagaacagccgcggatctggcattgatcgtacctgtcagtttgccgttcgctacttgaaatgaaccggcgccggccctattatcatacctgccgtcaggcaatttcgttgaagtattgacggtgacagaagacgatcccgcattagccagcacaacgccttttgagccgcgctgattcataaatatttgattgttcccattcggattcgagagttcctcaggctgcccggccattacattgtgaaattgattgaccgcagtgatcgcctgatctttaaataaggcgctcccgcgatctcctatttgactttttccgggaaatcgcaccccatttcctccgccctcaggtctggaaaagaaaagaggcgtgcttcctgagcgggaaccaatcactgcccagcctaaacggatatcgtcatcactcatccatgtggactcttcctcatcattggcatacgtatcatgtgattccacccatgtgaccaacttgtccgcagacacgtcagatgcataatgggagatattcgacacactcagattacggttctttaaagcggatctgatggaatgcccatagttagaagccgtcacattcatataattcgcataagcagtatctctggacgcgctgtcttgcaggatttctccgtattggaactccgccgatgtatttgtgatattcggccaaaatcggctgccgtaattcccatcatccggaagctctatatgcttggcggcatcatagcggaacccgtccgctccgtcattcaatgctctttccaagaaacgtttcagataggtttgcacctcagtattctgtgtattccaatcatacagcccaagcaatgaattttgagtgacgtcccacctgtccgaccaatttttaatttgtgtgtttccatgggtccagtttggaatacgcttaatctcgtcagaaatcgcggcgtaatcgctggtggtatgattgataaccgcatcaacaatgacttttacgccatatttttccgcggctgcacacatgtccttaaattcttgttcagtgcctaagtaacggttgccgatttggtacgatgtcggctgatacagccagtaccagttcctcatgcttttatctccttggttcccttcctttacttggttaatcggagacgtctgaatggctgcatagcccgcatcacgaatctctttcatattttgtgttaacgtattgaacgaccaattccaggcatgaaggatggtcccgtttttgaccgatgacgcggccacctcattcgatttgtttgcagtttcagcgtttgcagccgccgggcctgacaaaaccaaatgaaacagcaataaaaatccggcgaataacggcagtaaagaggttttgaatcgtttttcaaacatttttgacactccttatttcatttttgaagactgactgcggagtcaaaaattcctcttactctttcttcagctcctttcaactgttgtgaagactggagaattctgttaacgcttacatttcaacttatcacactctctctatcaaagcaacgcggcagagtgaattcaaatctatattcctatcaattaaaaagacttcccgctttcaaacaaaaaaagaaaccacctgtcaagatgatttcttttttatttcttttatcgctcttctgtaagacagcttcacaatgacataccgaagcagaaacagaatgcctccgcagacgataaaaagaaagatcattttcagccaagcaaagaatgtatggggaaaccccctgtcgtacatcgtaagcgccgccaccgcaaaagtgactgctattgaatctatccgctgctgcttcacccgctttttcagttcttctttggtgtctattctcggcatgagcattcccgacgctcccgccctgatgcaataataaacaattataatgaagaaaaccgccaagctcccggcccattccctaaacggacagttcagaacaagtccgcgtacgatgatgtcaagcaaagacagtgtgcccacaagcattccgacttctgaccaaatcattcgttctttctctttcacactctcactctttccattcacgtttgaaagtctgttccgacgctgattcatgacttcctcccgtactattaagaatggcttacaactcccattatatcttgccgattcataatgataaaccgaaatatcattgacaaaaatgttaataagggccccaattgatcaggacgcctatgcagataaacacaaggccgatgacaaaccaaatcagcgccagcggaatcatgaagcgaagccactttacgtacggaatgccgctggcagccagtacggccatcagaacgccggaagtcggattgacacagtttacgacgccttccccaagcatgaccgcttcaaccgcgacctgtctcgtgatgcccatcagatcggcaagcggcgccaaaatcggaataaatacgaccgcctcccctgagcccgatgatatcagaaaatgaagcagggcgctggaaatatacattccgattgcgcctgccatcgggctgaaaccgtgcagcagtgacgcaagtccattgactaccgtatcaagcagctttccgtgttccagaataacggaaatgcttctcgccattccgacgatcagcgcgccgtaaacgagcccctgacagcctgtaataaacgtttttgcgatatcatttgccgccattcccgcaatcaggcctgacacgattgagataaaaatgaacacggcggccatctctgaatcagaccagtcaagagtaagcgcgccgtataaaaagccggcaagcgacaaagccgcgacagccagaatcaatttatggcggacggtaaacgggactggcttgtcctccggatctgaagcctgcgggattgaacctgctgccggaaaccaatcgttccccagcagactggcgtcctttgcttttctgagccttctcgtataccgataaatatataaaatagatgatagcagaaaacaaatgtagacggcaatccgcaggccgatgccggaaaacagcggcagctccgcgatgctttgtgataacccgagcggtgaaggtgataaaatcgtcgcgttaaacccggcataacagccgatataaatgacggccgctccggccacggcatcccatttcagcgaacgggcgacgatcaggccgatcggaataaaaccgatcacggaattaacgacgatgccggttgtgccgaggatcgaaaatagagatccgacaattgcaataaacagcagctgtttggtgcggaacgtactgatgacattactgatcaatccattgatggcgcccgttttctccaaaatcgcaatggtgccgcccgtaaacaggattaaaaaaataatcggcgcggaacttgtcatcccttcctgaatcgcggtaaaaaaagcgatcgggctgacaggagactggtctaaagaatgataacttcccgggacggcggacgtcacactgccctttgtcaccctgtcaaattcccccgcaggaacgatgtatgatgctatcgcgcatagtaaagcgacaatgaacagcagcacataagcatcaggcatcacaaacaatttcttctttttcaatacaggttcggccttcggcacagccataacatcaccatcccgctttgaatttataaactattcagaaaatacagatatgtgctatattatatacagaccgattgcctgttttcaatatcaaaaataaaaaacagacagcttttgaaggaggacttacggcatgaacagactcacagagcatgaaaagcaagtcattatggacatttttgaccacctgcacgccaatcccgaagtaagctggaaagaatatcaaacaactgaatatctgactgaaaaactgaaagaggccggctgccgaatccgtacgtttgatgattgcaccggtgttgtcggcgaaatcggagaaggctcgcccgttgtggctgtccgggcggatattgacgcgctgtggcaggaagtggacggtgtctttcaggcgaaccattcatgcggacatgattcacatatgacgatggcgctcggcacgatgatgcttttaaagagtcagccgaagcttccgaagggcaccatccgctttatttttcagccggctgaagaaaaaggcggcggagcgctgaaaatgattgaaaaaggcgtactggatgatgttgacttcttatacggcgtgcacgtgcgccccgtacaggaaacggcaaacggccgatgcgcaccgtccattctgcatggctcaagccggcatatagaaggcctgattatcggagaagaagcccacggcgcgagaccgcatctcgggcttaacagtatcgaaatcgccgctcttctcgtccaaaaactcagcttcattcatcttgatcccggcatcccgcattccgtgaagatgacaaagcttcaggcaggcggagaaagttccaatatcattccgggaaaagcatcgttcagccttgatctccgcgcacaaaccaatgccgccatggagaaattaaccgccgaaaccgaaagagcctgtgaggcggcggctgccgcattcggcgcaaaaatcgaactgcaaaaagaacacagcctcccggcagccgagcgaaacaaggaggcggaagccatcatgacatctgcgatcagcagcattctcggagaagaacatgtggatgaacctcttgtgacaaccggaggagaggattttcacttttacgggttaaaggtgccgaacttgaaaacgacgatgctcggcctaggatgcggtctggagcctggacttcaccatccccaaatgacatttgaccgaagcgccatctttactggcgctgagatattaacggccgccgtcctcaaatcgtttgaagcataaaaaaaagcagcccgttacagggctgcttttcttcattacttcttcagatcttcaattgaattgacgtttttcatgtactgaggaacgaccagacccatcttgacgcctgtcagactcgttcctacatcttcatatttgcctttatatttagacgcatatgccttatgggtattcggaagccaagcagacaatgacgcatccgcgctgcctgtcgcaatcgcagtccacatcggtcctgcctccacttgcgtcagcttcacgtcatagccgaggtcttgaaatacttttccgattacattcgtacttgcgatttcactgtcccatgccacataagccaggttgattttatcccctttgactttatgggcgccttttgtccattgagccacttggtctttatgttttttcacatattcagctgcggctttggccggcttttcgccttcctcaacggcaatcatgacttctcccatatcgtcctgcgtccatttgaactggctgagaactttggccgcgttaggctgttccttactgaagccggttcttgtaatcgtatgaatctgctcggcagttccgtacgtttttttcggatcatcaaggaacttcagcttgtatctggagaacatccagtgcggcgtccagcccgttacgatgatcggctttttccggtcatatgatttcttcaatgtcgccgtcatggcggcacttgacgccgtgatgacattccagtctttcaatccgtaatccttcacggcctcatccgtcagggccatgatccccgatcccggatcgataccgataatggttttgttcacctggtccgcagccgttgccttatcatcagtctgcgaaccgcaggcagccaaagaaagagccagcgcagcggtaacgccgacaccgatgattttcttaagcatcaggcattccccctgctcttcttcttcactttaatgttttgcgtgatacggtcgagtgtaatcgctacgataacgatcgcgatacccgcttccactccgacaccggttttcaactgtgtcacggcgctgtatacttcagaaccgaggcccggcgcaccgaccatggccgcgataacgaccattgacaaagcaagcatgatgctttggttaataccggcaagaattgtttttgtggcaagcggaagctgcaccttgaacagacgctgagacgtcgttgaaccgaatgcttccgtcgcttcaatcagatcagccggaacctgtttaataccgagaactgtcatgcggatcgtcggaggcatcgcgaaaataacagatgccacaacgcctggcacaaccccgatattaaagaagaaaattgcaggcagcaggtatacgaaagccggcatggtctgcattaaatccagaatcggtgtgacaatgcggcggactgtttctttctgagacgcccatatgccgatcggaaccccgataataatggaaatcaaaacagatgtgacgacaagcgccaacgtttgcagcatcggcgaccaataacccaaataatcaataacaaggaatccgattaacgtaaagagtgcaattcctctcgtactgatccaccaagcgagagctgcaaaaataacagtcaataaaatagacgggatgaaacccaaaccgctcacaatcgcgtttacgaaagcggccaaaccgtttgagattccgtcaaagaaacctccgaacgtcatggtaagccagtcaacaaaccggtcaacgatatctgctaacggaattctaggcaatctgtccatttacttcaccccctgaacagaagaatcctgagcttgttcagcagaatcttcaacatttatataatcgttatttcctgaaagcgcgccgattaatgcgccttttacgacaatgcctttcatgcggtccttatcgtccgtgacggcgatcggaatattcgcatcagacacgacatcgaaaatttccgtcaagtatgtgctttcatgcacagtcgtaaattcagtatttaaaatatcctgaagcgataagtcggattccaccgcttttttcgcatccgccgcgtgaatgacgccgagaagctgtttctgtttatcaacggcgtaaatagaagaaataccgagattcttcatgagctgcagcgctacacgaggccctttgtcaatccgcacggtttcagcgcgcttcatgatgtggcccgctgtcagaactttggataagtcaacgtcctcaacgaatttctcaacgtattcattggacgggctcatcagaatttcttcaggcgtcccgatctgaacgatgttaccgtctttcatcagcacgattctgtcgccgatgcgcaatgcttcatcaagatcatgcgtgatgaagatgatcgtcttgccgacagagtcatgaaggtctaaaagctcatcctgcatgtctttgcggatcagcggatcaagcgcactgaaagcttcatccatcagaagaatgtcaggatcattcgtcaatgcgcgggcaagtccgacacgctgctgcattcctccgctgagctgatctgggaattggtgttcaaagccttcaagaccgacaagtttaagcgaatcaagcgctttttgctcacgctcttttttgtcgacgccttggagttccaacccgtattccgtattttcaagaatcgttctgtgcggaaacagcgcaaatttttgaaagaccatgctgatttttttccggcgcacttcccggagctggtcttttgacatatttgttatcatgtcaccatcaatataaatattcccggcagtcggttcaataagccggtttaacagccgaactaaagttgatttaccgctccccgatagacccatgatgacaaatatctccccatcatatacatcaaagtttgcttgattgacaccaacggttgatccggtcgctttcaggatctcttttttgttttttccgctggacagcatctgaatggctttttttgtctgttttccgaaaaccttagatacattttcgacttttatcttaattggtttctcatccaaattcatattttccctccataataagcaatctttaataccgtaacacgtttgtaataagtcaaacaaacatcataatcccgtttattttgtatcattactttaaaaacatccctgtgtcttattttcctctggtatgcttctaaatactctctaatcctccttattgaggataaattataaaggaaatcgggcttttatcaggcttgagaacgtttccatcgaatgtgctgcaaactgatttcctatcctttttttacaaatacaagaatttttttgcgacattgtcccggaaaaagaagttttcgcctcctgaaaataagggattttaaggaaaaatataggtctgccaacagacagctcactaaaaaaagcaccccaaaagggtgctcattgcgcaagctctgtctgtttcgtttcttttccgagaataataatggtgatgacggcaatcaggatggccgcacaaaagacagcgaaaatagctgtaaacgaaacgttccgtgctgcaagcgatccgacgagaagcggaccgaaaatgccgccgattctgccgacggccgcggttgttccggaaccggtcgcgcggatcgccgcagggtactgctccggtgtataggcgtaaagcacgccccatgcgccgagattgaaaaaggacagcagcatgccggccgtgagcagcatggccaatgaatccgcggcaccgaagaaataagcgctgcccgccgttccgagcaaatagatgactaagatggtcttccgccccgctttttcgatcagccacgccgctgagaaatatccgggaagctgggcaagcgtcatcagaaggacgtattcgaagctctcaatcatgctgtagcctttcatcagcatcacgctcggcagccataaaaacatgccgtaataagaaaagacgacgcagaaccaaacgacagacagcagcaccgtcggccggatatacggtttcgtccagacacttcccgcctgcccgcgtatgctttttttctgcgtcaatgcctgatgcgccggtgattccggaaggcttttccgcaagtacagcgcataaaacgcggccagcgccgttaagagcagtgcggcctgccagccgaatgacggtatgacaaagtaggaaatcaccgccgcaagaagccagcccgctgcccaaaagctctcaagcagcacgatgatccgtccccgcttttcgggagcggacgcttctgacacgagcgtcgaggcgacaggcagttccccgccaagccccattccgatcagaaaacgcaatatgagaaaaaccgtcaatcccgttgcaaaagcggatatgccgcttccgacagaaaagaataacagcgtgatcataaacacttttttccggccgatcctgtcggccagcattccgaataaaaaggcgcccgctgccataccgatggaattgacgcttccgatccatttcatttgatcgggtgttaaattccaatcagtgtgaagcgcggcgataataaacgataaaattccgacatccatcgcatcaaacagccagcccattccggcaatcgccagaagttttcgcggagtgacggcaggttgtttgttcataagcagcacctcaaatcgaaaatgattaccgtataagtttacacctgtctttacacattgtcattatcttttttcgcaaaaaaacccgcttgccgtaagcaagcggggtgcagattaattctttaagactgcgtttttaatattatcctgaagctgttgaatccgtttcgctccgtcttctctgatacgtctgttctcttcctcgatctgtttcgtttcctgcataccgctgacaatcgtattccaagacgtttcaatcgtctcaatgtcaatgctcggacggcctgccatacgggcaatctccacgctttggtttgaaatattttcagcgttgcgcttcagcatttcattcgtgcggcggtccagctcgctcattgaatcagccacaagcttttgccgtttgactgtgacagcctgaatgatgccgtttttgaaaatcggaatcgtaatgacgaaagcggaattgatttttccgatgagcttcgtatttccgcgctgaaggaggcggatctgcggcgctgtctgcagcgccaccatccgcgccatatctaaatcatagacacgttcctcaagcgcctgaagcccgtcacgcagcgtatcaagctgcatttgcgcaagctggtttccgccggccgctttttcttcataagaaggaatgagcgcctgcatttcctcaagcttcatctgcccggcgacaacatatttttcaagctccatgtagtagttaatgttgttttcatacatctcttcaagcgtatggttcgtctttgccatttcatctttgtattttgaaatttcgacgtggattttttcaatttctccgcccagggtgcggtacttttgaaaaatcttttcaatcatgctgttgccgcgtttgaacattttagcgagaaatccttttggttcatcgaaatcatttttgtcgaaacggtccatgatttttccgagctgcgtcagcattgtgcctgaatccgtgacacttgttgttttcatcatatttaagatgcggtcggagaacttcgagatttcaactgccggttcttttccgtactcaagcagctccatttggtttttcacgtcaatctgctgcgaaatgcgctgcacctcagggtcttggcgcagctgcgccctgatgtcatctgctttttgttcagaaatctcttcatttttatcaagaacaagcggattttgattttctgtcatatttatttactctccctgcttttgcgtaatggttctaaacagctttcttacgagtgacggctccttatattcctgccgaaacaccatgtcctccagccaatggacatcaaattggctttcttcaatataatgctcaatgtcctgatggcccggcggattatacaagatgatatcgacgccgaatttatttaaaaacaaaagagcggcggcatcagaacgtgtgagttcgccattttgttccgtatgatataaaacgagtttcggaacggtttgggcgtaatcaaacgtctgaatcaattgcagcagcgaagcgggcagattcgtcgcctggcggaacaaatagattgcggcatcccttgactgctccccgggcaaagccttcagccctgggtttctgcacatgtcagaaatcacattggcgatggcgctctgcacacctgaaggcagatgcttgtactgccagatgttgcttcttttcagcctgtccgcgtcaatctctcctttttcatttaaaacctgactgtagtgatactggtagttggctttcagctcttccgtaaacggaaaactgcggatcatgtgtgtctcctgatagtccgcggcggtatggagtctgttccaatattctttcgtatctttggaaacccccatcactttcgcaaaaaggttcggaacggccacccgctccctgtccgctttaaattgcggccggataaacgcccgctccttcgcaatgagaaataactcatcatacgtcgtttttaaggtcacggactgcggggtgtgctccctgaactgccaaggcttatacatcatggattcctcatggttcagcacatgctcaatttctttcgttgaccggtaggccgtcgtggacgttctgtccggcttttctttcggaaaaggctcaagaccgcctgttgcggggagctttatcacaaagctgagctcctcatccggatcaatcaagctgaacggatcttccgcagccggatgaaacaataggacatcacagccgatcagcatgagataatagagaaaatagagctggcttttggtcgcgtctccataccacaccaccttcggcatctcacactctatatcggcttgttcgagccatggattcaggtggttcagcgaaaactttgacacatccaagagcacacgccggaaatcgggatgattcagcccgttttcatgccggtccgcaaaggtttccaaaagcgtcataaacgcggtcctcagccggcggtgcataagcggatcagcgtgtttggcaagcagcctgcccccatcgagaaacgcgacaaacctggaaaccgaaagccctttctctttttgattgaccgaatgaatgtgctgcagcgcctgaaacgtttccggcgcgatggtcttatccagcgtctcgctcaacacatggatgttttcatgagaagacagctcgaaaagcttactgtaatactccgtctcatcataaggagtgcccaaaatccggccggcaagccgggtaaacgccagcccgttttcccgctcgtaaccgggacgttccggcagcggccgcatcagaaacgtttcccagtcatcgttttccggctcggcctttcggatcaccaattcttcctgcttcatcattttcctcctttctcttcatgataatcggtacaaaaaaggaaggaaatgaactctccctccttttttgttttattcttctttagatgcagccgtctgctcctgaacctgcttttgtttgttgaaatagtggataataaacgtgaccacaaatgcagcgatgatgattccgaagaacaccacgtgcggcatttcataatcaaaagcgctcgccgccattttcacggcgataatcccgatcagcacgaaagccgtgttttcaagctcagggattttatcaattaacacaaggaatacttttgcgactgtacgcatcatgagaatgccgagcataccgccgatcaagagcacccacactttttccgataccgcaaacgcggctaaaatgctgtcaacagagaaggccagatccattaactcaactgaaacgacagtggcccagaaaattccgaacgtacggaccatccatgaatttttcttcatgccttccgtatcgtcatcaccttctccgatccagaaatgcttaatgacgagccaagccaggtacagcgcgccaagcactttgatccaccagaacttaatgagcagcatcccgattccgataaagataaagcggaaaatatatgccccgaacaatccgtatgttaatgctttcttccgctgtttttcaggcagatgccttaccataaccgcaagcactaacgcattgtcggccgacagcagcccttccagcagaaccaaggaaccgatcagcccccatgatacagggtcagtcagcacctcaccccacattttccaatcaaaaaaggaagcgtaggtcgacataatatgatgtagaaaatccaagttttttcctcctatttagtaaaacggtaatttcctgcttacacctgcaagccgtaattccggcaaagtgatgccagaccgccggaaaacccgctgccgatggcgttaaacttccattcagccccatggcggtaaagctcacaaacgacaaccgccgtttcaatcgagaagtcttcccctaaatcgaaacgaagcagttcattctggctgttttcatcgacgacgcgcacgaacgcgttcgaaacttgtccgaaattttggccgcgcgcttccgcatcatgaatcgtgacggtgatgccgatcttttcaatatttgcgggtatttttgagaaatcgacgataatttgttcatcgtctccctctccctcgcccgtccggttgtctcccgtatggatgacgccgccgctcgggtgttccaggttattgtagaaaacaaaatcaagatcattaacacagttgtcatgggcatcgacaagaaaagccgacgcgtcaaggtcaaagtcatgccctccggagtacttgttcgtatcccagcctaagccgatcaccgcttttgtaagaccggggttcgtttttgtcagatcaacacgctgtcctttcgccaattgaatagccatgtgccgtctctcccttctgtgcttgatatggttttagccgatttgcaggccgtaatctgtcgcaatacgggccagtccgccttgatagcctgagccgatcgcggaaaatttccattcgccgttatgtctgtaaagctcccctgcgataatggctgtttcaattgagaaatcttcagccagatcgtagcggatcagctcttcatttgtctcttcattgacaatgcgaacgaacgcgttggaaacttgtccgaagttttggccgcgcgcttccgcttcatgaatcgtgatgacgaatgaaattttgtcaatagcggcaggcaccgcgctcaggttgacccttacactttcgtcatcgccctcgccctggcctgtaaggttgtcgcctgaatgtgcgacagagccgtttccgccttcaagctgattatagaaaataaaatcatcgggcgacgcgcatcttcctgcttcatttaatagaaagacgctggaatctaaatcaaaatcatgtccgccatcgtatttgtttgtatcccagccaaggccgacaacgactttagaaagacccggatttgttttagtcaaatctactttttgtccttttgccaatgaaattgccatgtgtgcactctcctttttatcgtttaggcgtatcggttaacgatatcgccgatttttgtatcgtttgtgccttctcctactgcggcgaatttccactcgccgtcctcgcggtagatttcagccgcgatcaggctcgttctgcctgaatagttatctcttaaattgtaagtcaccagttcttcgcgattagcctgatcaacgacgcggatgaacgcgttttgaatcatgccgaagtcctgttttcgtctgacgcagtcgtaaatattgacgacaaacacaagtttattaatctgagcgggcactttcgacaaatcgatgagaatttgttcatcatcaccgtcgccttcacccgtcaggttgtcacccgtatgtacgacaccgccgcaccggcttttcagattgccgaaatagatgacgtttttgctgtctgtcattttatcattttcaagcatcagtacggaagcgtcacagtcgatattggcaccgcctccgccgaacagctttccgaaaaagccgccggatgatacagggtcccagccgagtccgaccagcagttttgacaggccggcttttccttttgttaaatcaatccgctgtcctttttgtaaagagatcgccatatgattcactcctattctgtaagggtgccgctaagcacgccgcaagtgcgcatttttactaaattccgggacaagaatcccggtgtttattaagttatacgtcttttattatatcaaagtttcataaaacataagaatttttggcgaaaaacggcgaaaaattacttcctatattctccttcgttccggagagaatagagaaaacaaagaaattgacggggactgaacatttttcctatccttgtatcaatacatgtcaggaaaggggcagacgagtgattgatttaagcatacttgatcaggcgcccgtatccaaaggaaacgggccgcacgagacgctccgccgttcagcggagctcgcccgcctcagcgaaggatggggctataagcggtactggtttgccgagcatcacggcacaagagggctcgcaagcgtttcgccggaaattatgatcgctcataccgccgcagccacaacgtccatccgtgtcggatcaggcggcgtgctgctgccgcagtacagcccctataaagtcgcggaaactttccgtcagcttgaggcgctgcatccgaaccggattgaccttggggtcggacgctcaccgggcggcacgacgaaaatccggctcgccctcacagacggggtaaagaaaagtatgaccgagttcaacaggcagcttcaggatttatcatcctttctgacagattcggttccctcggaccatgcttatgccggaataaaaacagcgcctttgattgaaacagccccgcagctttgggtgctgggcctcggggaaaacagcgccagacgcgccgctcttcaaggtgcgggctatgtcttcggccatttcattaatccggaacgcggggtaaaagcctttcagatctatcgggaccatttccgggcctcctcccatttttccgctccggcctcactctgtgccattttcgtcatatgcgcagctacggatgagaaagcggaagaactcgccttaagccaggatttatggcttcttcgtgtcggaaaaggcgccgacagccgcgtgccgagtgtggaagaagcgaaggcttatccgtattcgccggaggaccgtaaacagattgcagaaaataggaagcggatggtgatcggctctgctgccgcagtgaaacgccgtctgcttgaactttccgaacgttatcagacaaaagagatgatggtgctgtgcaacgtctttgatttcgaagcaaaaaaagagtcatatgagcgtcttgctgatatatttctgtaaaaaaagccgtcaaacggcgcagcagatgagactgctgcaccgcttaacggcggttttttcgttcttttccttttttaaacgcattccaaatcccctgcagcataaagccgagcagaagcagaatgattaacagtaaagtgattgacggccccggaggcgttccgagctggtacgaagacgtcagccccatgaacacactgaaaagagaaataataatggccgccgcaaacacccatttaaaccctttggcgatacggattgcaaaagccgcgggcagtacgaggagcgcggaaacaagcagcacgccgataatcggaataatgaccgaaatcgccagccccgtcacgatgctgaatgacattgacaggagatttgtgttaatgcctgatgtcttcgccgtcgcctcgtcaaaggtaagcagatagagcggtctgtttaatataatgaaataaagcagaatcagcagggtaatgcctccgataatatagacctgctgctggctgaccgtgacaagcgatccaaataaatattgatcgatgctcatcgacgcgccgccttttgacaggctgatcagaaacatcgcaaacgacagcccggccgccattaagattgcgatggatacctctgaatatgtacggtatgcccgccgcatatattcgatgccgatcgctccgatcgtgacgacaacgatgctcgccgccgtaatattggtactgagaaaaaaaccgatggccacgcccgacaatgaaatatgagacagcgtatccgccatcagcgcctgtcttctcagcacgagatatacgcctaatatcggcgccataattccgatcatgcttcccgctagaaaagctcgtcgcatgaattccaagtcaaacatttccatccgcctttttcccccctctcaagccgtatgactttatccaaatactgctgtacttcattttgttcgtgtgtcaccatgacgacggtgcggttgtgatttttcacctgatgatgcataaattcgtagaaaccctgtctgctttcatagtcaaccgcggttgtcggttcatcaagcatcagcagatccggattgcttgcaagcattctcgcaatgcagattttctgcttctgtccgccggataaatcgccgattttccggtggcggaaatcccacatttccaccatcttcagcgcgttttccacctcgtggtgatccgtttcgttcaatcgtttaaaccattttcctttcgtataacggcctgattgcacaagctccagaactgtgcttgggaatcctgcgttaaatgaagaaatctgctgcggaacatagccgattgtcaggcgttttccggcagcgttttttttactgatctcggccgttccttcccaaggtctgagcatgccgagcatgactttcatcagcgtcgattttgacgcgccgttcggtcctgtaatgccgacgaattcgccgcttttgatttccagcgacacaccgtcaagcacgggtgtatgcgaataaccaaaaacgatatcctgtaatgtaacgagattcatgctgaccttcctttcccgcatagaaatagtgtgcaccccgcggcgcacactatgttatttaaccaatagcgaatctttcagtgcatcaaggtttttctccataatgtcgatataaccgatgcctttatcccgttctttttggcttaaaccttccagtgtattgagcacttccgttttcgcgccgatttcaccggcaagtgtatctgcaactttaggcgatgcaacttcttcaaaatagatgatcttcacatcatgctttttggcaaacgttttgagatccgccagtttggccgcactcggctcttcttcaggagaaaggcctgcaatcgcgacttgttttaagccgtattctttggcgagatagctgaatgccgcgtgctgtgtgatcaattcttttttcgacgctttatttaatgttgtacggtatagtttatcaagatcctgcagttttgcaatatattctttactatttttctcatagtatgctttattcttcgggtcctgttttacgatctgcgccgtaatggttttgacctctttttgcgcaagaaccgggctgagccacacgtgagggtccatgctgtggctgtggtcatgaccgccgtgtccatgttcctcttcctcttcatccgaaccttcgagcaagtcaattcctttcgacgcctttacaaacttcgcatgatcagagctcatgcttttttccgctgaaggaacccatgtctccatatattcgctgttgtatacgaaaagatcggcgttttgaatgccggcgatatccttcggcgtcggctcccaatcatggggttcgaccgaagacgggatgagaatgtctacatcgcctttgtctttgacaatttgtttcgtgaattcgtacataggataaaaggtcgtcacgacgtgcagtttgccgcttttcgaagaacctgacgaaccttttgaagatgaattgccgcagcccgccgcgattaaaaagcatgccgcaatgacaatgattccgctccattttttaaacaagccgtttccccctgttctgtaaatcagaatgatgacgatttccaaagcgtactttctcgttcatttgttacctataccataataaaacgaagtaattacgttttgcaagtaatttttttctaaattgataaccgatttacctaaaaagcccccgccatgtatggacggggcgtcgtatcacatatcaggcatgcagataaactcttgtttcgtaagggcggaacgtgatgcgggattccgctccgccgttattttcatagttgctgagaagcagctcggccctttcagattcggagccgtccggccaataaaaggcggcttcttctttcgatacgttgctgatggatatgattttttgtccgtttgcctgtctttcatacacaaacagctgcgggtcatcgggaaacagcagcgtgtagctgccttttatgatatcagcatactgttttcgcaggcggatcagttttttgtaaaagttcaatatagaattgggatcatcctgagcctcggccgcattgacggttttgtaattgggattgaccttcagccacggttcgccctccgtaaatccggcattcttgctgccgtcccactgcatcggtgtacgggcatgatcgcggcttttcgccataatggacgccatgacttcttccctgttgcggcccatttcaaatacccttttgtgatacatattgacggtctgaatatcttgatagtcctctattctgtcaaacggggcgtttgtcatgccgagttcttctccctgataaatgtacggcgtgcctttcatgaaataaagcagggcggcaagcattttggcggatgcctttcggtatttgccttcgtctccgaagcgggatacgatccggggctggtcatgattgcaccaatacagcgtattccagccttgatgttccagtttttcctgccagtctgtgagcactttcttcaaatcggacagctcaagcggttttacatcccaatgctcttggcccggcttttgatcaagctccatatgctgaaaatgaaaaatcatattcagttcatgctcatcggttcccgtgtaaaccagcccctcctcaggcgtcactgatccggcctcgccgaccgacatcacgtcatattttggaaaatacctctttcgtcatttcttttaagtaatcatgtatccgtgctccgtttggccggaaaggcttcggatctgcccggcgggcgatgtaatcttcatatggcggcaagtattctttttttgacagaagatgaagctggtctattcgcaatccgtccacgcctttatcgagccaaaatctcatcatctcgtatactgattgccgaacctcgggattttcccaattcagatcggcttgtttaacggcgttcatatgcaggtaatattcgcccgtatgttcttcgtactgccagacggattgtccgtaatccgacacccaatcggtcggcgggccctccgcggtgcccggccgccaaatataataatcgcggtatttgctgtccggattcatttccgcctctttgaaccaaggatgctccgtggaggtatgatttaaaacgaagtccatcacaagctttaatccgcggctgcggcattctgtaagcagatcgtgaaagtcctccatcgttccgtatgattccataatcgcttgatgatccgtcacatcgtagccgttatcgacgtttggcgacgggtaaatcgggcagatccatatcacatcggcgccaagctcttttatataatcgagacgcgcgataatcccccgcaggtcgcctatgccgtcgctgttcgtatcttggaagcttcgcggatagatttgatagacaacggcgtctttccaccagtcattcgccatcttgcggccctcctgttttttagagaaccatttcctgtatgccccttctctaaacaaaaaagagaaggtttcccctcctcttttatctttccagctgggacggataaagcgtcatgcctccgtctacgaaaagtgtcgttccggttacgtaactcgcttcttccgacaccatccatgcggcggccgcggcgacttcttccggttttccgaaggcgttcatcggaatttttttcagctgggcctgtttatgtgtttcatcttccagatccttattggactccgtggcgatcgtgccgggagcgatggcattcacccggatgcctttgtctgcgtaattgagcgccatcgtttccgtcatcattttgatcccgcctttggatgccgagtactgcacgttttcaggacgcggtatttgctgatgaacgctcgatatgtttaagaccgttccttttttgccgtgctcgagcatatgtttcagtgccgctttcgcccccaaaaaggtgccggtcacgttgacgtcgatgaccctttgccaatcctccaggctcatttcatggggcatcgcttccgctccgttaaagccggaattgttgaccatcacgtccacgcccccgaaatgctcctgcgcggcattaaacagcgcctgaatcccttcttctgaggatacatcggcttttacggtgacggctctgcctcccgctttctcaatgatatccgccgcttcttccgctccggcggaatcaccgaggtagttcacaaccacattcatccgctccttgccgaagcgttcggcaatggcttttccgattcctttcgaagaacctgttacaatcgctgttttcccctgtaaatcctgatacattgtctcatttcctccctgatgttaatacagagcatgtacccggttttaatcggctgaaaacaaaaggaatcataaaaagaacgatgaaaccgaagctccctcgttcttttttttattatgcgtagttgttcatttgcagccttttttgcacgccgacaagcctgctgaaaaaataagatgccgctttgtagttctcccgtttatgaaagaaatgagccgcgtcctgaagcagttcctctgtgtcagccaacagctcctttgattccaggatgtcaaaatactctttgagcgaatcctgtccgccttcccctgataaagctctttaatcagacggaatttcgtcatatagatctcatcttcccactccgccgcgcttctcatgccccgcgcgcagctggcggcggcttcactgtatttttccgttttaaagtagatatgcgtgagtgaaaaaacagcctggatgacctgccggaagctgtgtgcttcaaatccggcagccgcccgttcaaaatcctccgccgccttgcaaaagtcacccagactgtacatacagtgcccgatattataataggccgcagcaatcatatattgatcatcaagccgctccgcgtgctccaaggcgcattcgaggtattccagcgcttttttatgctgctgggcgtccatcagatttccggcaatgataaatttgcactgcacccttctcattccgtataattcatatttcttgtaaatatcaagcgcctgccccgcgtaattcatcgaaaagaaagtctgcttgatatgatagtacacctcagaaattttatacagaaactcggctttctctatgtcatcttccacatattcaagcttttcctcagcccgcttataatgagaaatcgctgagatgaagtttttctgcttaaattcatacattcctctgaaatagtaaaaataatattccagtaagccggtcagcttttgctggttcatctcaatctcagtgagcatttcagagaacggaggctggcagtcgccgtctttcatgggttttaatttatccagcatgatgcggtgcctaaattccatcaatgaaaaatacaacaataaatcctgattttcttccatatcttcgagttcatattgaatctcccgcttcagcgcttcagctttatcggcttcaaacgcgcggatcagcttataccattcattcatctttacggccacttcttcagatggaatcttggatttcatagatttgcctccttcctccggctactaattatgttatattttatcatagcaaatttatggcagtgagcaaacaaagattttaatcaattaaagaaagagagaattcaccatgaaactaccagtcagaatttcgctgcttctgatcctcttcttttccgcagacctatgtttttcctatgtgcagaaagaattgaggccgcagacggcattacaagatagagccattccaagcgctcttcatccgctcgtgaaacagaatgcggagctattgcggacggccgctctgaaaaaaggcatcaccgtcgttatcacagagggtttcagatcaattgaggaacaaaacgaattgtaccgtcaaggacgttcaaaaaaaggaaatatcgtcacctacgcaaaaggcggggaatcttaccacaattacggccttgcgatcgacttcgccctgcaaaaaaaggatggaagcctgatttgggatatgacgtacgacggaaaccgaaacggcacgcccgattggcttgaggtcgtatcgattgccaaaacgctcggttttgattggggaggcgattggagaggctttaaagattatcctcatttacaaatgatccctggctaataaaaccttttcttttttcgcttctgcgcatcaatgtacggaggatagacaggcctgtacacaagcttatatccttcattgccggacggcgtaaaatcgcgctgccactccagccgcagatggaaatcggataaaaaagcggcctttgcttcttcgggagtaacggccggcaccggattgatcttctccagctgctccgggtcaatgtcaggcgccatataagcttccacaagccccgttacgggactgacaagtattctcgcagcgccgaaccgcagcggaatatcctgatgccatacggaaaaatggaagcggaacctgccccttccgtccgttttcagcgggttcattttaaaaaactcgtccgctctcggataaagcttgtataaaaattgaagcgcgacggcctcacactcttccgcagaataaaaggccgggccctgatgctcaataaaagatttaaaggctgtcattttccctgtctttttgtccgttttcatcttcattgtatttttgttgctggtttcaaaatagctttcgatactcaaatctttccgttccggaaccgaccctttccgccatgtcgttccgatctcatccccgagatcgcgccggcgcgtctgaaccatatccgaggtaaaccccatcaattcatccaggctgatttcccgtttatgttcaaacgcaggaagcggttttgccggctcattcctgtcttcgcaaagctgctgatccggcacgatatcatcttcaccggccggatagctgtaagccggcagaatcggttcatagacgagacgcggtatgttctcaaaattgaccacatcatagacgagactgaatgtcagcacactcatataatgcgagacgactttttcccgatcgacgaatgtttccgggacgggcgcttcacccttatccccgtaatagataaactgcacgacgaagccgctcctggttacatcaacgaaaaaacctgaatcgggaagcggccggccgagcactttttttgtatagataaatcggatgcacccattgcgttcttccctcgcctgaaagatgaaattcataaaagtaagcgggcggtgtctcgccgcaaaccgaagagccgtcagctttaattcggcgtctgacagctgcatgtctgaacccggacagtcgttgcgtgaataggtaagcaaagatccgtcgtcgcccagctcaatcgttaccgttttatccggatggttacgatctttccatatataataggctctcgttttttgtttttcatcataatcttctatttcaagctcatagtgcggcggtatgttcccgatctccagcgctttttttctcagatgttctttcagcaatggggtcatcctttcagaagagtgtataaaaaagaactgtttttaattatataaaaacgtccttatccttttaaagggaagaaagtgccttttatgtgtctatttttagcaaagagggaaaagagccgtattcagagcggctgtttttcatacaatagtcacaattcccgcaaaagacccgggacgaacgcccatgaccttcagcctattaaactcgtgatcacttctcccgtatgggcctcaataaaccgcgggaaaaccggcttgtatacgagcctgtacacttttccgcagctgccgtcatcgtaacaacgatcccaagcgagctcggctttgatggcccggcggatcgcgtccttcgcctcttccattgtcaatgaaggaacgggatcgatttcctccagctctttcggatcaatttccggcggcatataaaacgtgacaagacccgtctttttgctgacgcagattctcccctctccgaatcgcaaatcaacgccgcccgaacaagccttatatgtaagtcccacgttttctccttcatcatccggctcatcatattgaacccggaaatactgatccgcttccggaaacatggcgaataaaaagcggatggccatgtgatggcattcttcctcggaaaactccggttcgccttcactatgtataaatgacatcactccggcgagccggcccgattctttatcatgcattgttttcaatacatgttcattccgttctttaaacagactttctaagcttttatctttccggacggattttgttttttcaggacgccatgcaatgccgatgcggccgtctccaagatcagtttccctctctttataaaaaccgtcgtgcagcccgatcatgtcattgatgctcatcttttccgcttcaggtgcagggcgtgaaatcgggacatacggcagcatgtcgtcttccagcccttcatattcgtctatttctgcattctcttccttcaggtcagccgatatcggccgcgtcggagacacgatttcatagacgagatgaggcttgtcatccccctgcacatagacggactgatgcagtacggtgaacaacagctccgcttcaatatgtttgacaaagtgagccaatgcttcccgcttgtccgcaattgttccgggtcttaagagattatcagccttcccatggtaagaaaagccggttacttcccctgtcaaagacaggtcggcgtaaaacccggtcagcggaagcggcagaccgtcagccatctgaacataggaatatctcacatcaccatcatttgcggagccgctgttttccaattcgaactcagccaatgcccccggacgatgggtttctacaaacgcccgcatccgttcttctatgtccgattccgaaagagccggcagatcagtccggaaagccggacgggataaggatttcagttttccgtcccggtccaattcgaccatgatgccggcttccggatcattcttatcttcccaccaaaacaaaacctcatcttcttggtattcttccacattactttcgtagcgggcaggtacgttaccgatccggagagccagctgtttcaattcttcttttttcatcataacacttccttttcttccaaaaagattgatgattaccaagactcttttatacaaaactagtataattaacctgtctgtcttcatgactattgaattaatcattataacaacagggggtaaaccagatgtccatcaaaaaaatgagcgccgtgtttttcatactgcttctcacggcatttaccgccgcatgcagcagcgaaacgagcggcggccaggaaagcagcacggcgaaagtgaaaataaaagagacggcatgggccgcttcagacgatactgaacatccggccgcgctgaaagtaacggtcaccgtcaaaaatacgggcaaagacccgcttaccgtcaaaagcagcgacttctcgctttatcaggatgacgcgaaaacagcggcggccgataaggatgaccagatgcagagcggcacgcttcatgcgggcaagacagtgacgggcaatctgtacttcacggctgacgaaggcaaatcatatgaattggtatatcagccgcaggcaaaagacgcgaagcctttatcttataaactgaaagtcaaaggcacagcctcaaacgcaaaacctgacccggcggacgcattatccgcatacattgatgtgatgctgtacggcaagcacaataaagatttcacccgcctgaccggtgtaaatgaaaaaatgacggccgccgcatatcaggaatcggcgaaagccagctttatcgcttctgcaggcatttcacaagaacaggcggattcaaaagccatttccgctattattgacgccatgtcatcagcgcttcgggataacacagagctcaaggtgcataccaaatccatgtcaggcaaaaaagccgtccttgaagcaaaagtgacgccgcttgatatgtctccgctcgcgggccagctgcaagaccgcgtgcaagactatgccggaaagcaccccgatgctgatgaaaacgaaattgtcagccacctgctttctgtctatccggaagagtttatgcgcctgaaaccggcttcttcttccgtaacaagagaaatcgagatgaagaaaaacgcccgcggccagtggtatctggatacagacgccgatctggaaggattgacagaagcgtttttgaaaacgtcctgacagcaagaaaggaaatagcgcaggctatttcctttttttattttcacttgaagatgtcactgatatattgaacctcatcctcggtcaattgcacatcaagcgcgcccagattgtgtttcagctggccggggcgtttggctccgggaatgatcgcatccaccgccggctgcgacagaagccacgcgagtgcgatatgcgctgtctgcgcccctttttcttccgcaacggcccgaagcttatccactcgctccaggttttggtgaaaagcttctccctgaaacggcggcctgttttttcggctgtcctcaaagactgtgtcttttgtaaactttcccgtcagcaagccggaagcaagcggaaaataaggaataaaagaaataccgttcttttcacaataaggcagcagatcatgctccgcctcacgctgaatcagtgaatattctgattgaaaaacctctaaataaccgtcggcgttaaactcctgcaattgcccgaagctgagattggacgcgccgattgctctgattttcccttcgtccttcagttcttttagcgtgcccgccacttcggagagcggtgttttgccgtcagggaagtggacgtaatacaaatcaatcacgtctgttttcagccgcttcaggctgttttccgcctcactacggagaaattcacggctgttgtccagctcgatttgtccgttgacctctttgtgcgcgccttttgacgcaatcacgaggctgtcccgcacgccgcgctctgcgacaacttcaccgattaactcttcggaacgccccaaaccgtatataaacgccgtatcaataaaattgacgccgccgtccaacgctgtgcggatgagttcttttcccgtttcatcattaagattcggaaacagattatgtcctccgaccgcattagcgccaaagccgatacgctttacccgtaaatccgtcctgcccagcgtacgtgtctcatccatggctcaggctcccttccttttatcgctctgtttagtattagataactggtaagaattatcctgccccgagagcatttctgcagaaaaaaccttgaaaagcatgtgcccttcaaggttttttggctgtgtattaagatgtcagagctgcggcgaagcgttcggcttcatctgtgagagcaccttcgatttccttatagcggctggaaatcgttgaggcgctgacgccgtacttcttcgccagcttggcttgagaaacggacgcgccgttcagagaaatactgtttacgtaatattcaaccgccgccgcgaaagcttccggctttctgatcgtcggtgtttttttgacacagaacgttttccacaggtcaataacggccggaaccagctcagccgggtattcatccccgctcaggcctttttcaatggcgtccgccgtttccttctccatgtcgttcgcccactccgtctgtttttcttcagcagcctgctcaggctcttccgccgttcctaaaagagcggccagcacagtgtcgaagtcctcctgcataaagcgctcaggcgattttccttccgcaagggccggggcagccgcctttttcactttgctgattagagcttcggtccgcttcacagggaagatcgtaaactgcataaagaactccgctttttccgcttcgtggatcggatagccgagaatcaggcttcccgccggcggaagatcctgctggctgacgtccatttccactttgaattgtttcttggtcatcacatcttcaaagtgaatcattccttctttcacatcttcaagcaccataaccgctggtgtcatgcttttccatgattcaacgatttcccgtgttttcggacggttgatgccgccggcttttttctgaagatattcttcaaaaatcgtcttgccgcctgccagcggacggaagaaaattccccagataccgaggttgaagactccgatgtctttagtctgtctgtccagctccgtaatgaactcatgctggttaataaatgatgatatgccgtctctatgtgctgtaaaggcgtactccattaagctttcctgaatctgtttcgcttcttttgccgcgatgtctgccggaatggcagcttctttgcttccgcagcattttttatatttcttcccgctgccgcatgggcaaggggcatttcttttcacttttcccacaataaaccctccgaattctgatataactttattattttaacaaaaataacttcagagggcttggtttacggcgaaaaaagaatatggaagaaaaaaaggccccgggatattctcattctccggggctttgaaactgttaatttgtattttgtccgccgccgttcagaccttctttaatcagcccgtttacttggctgttcatcaaaagtccgatgtgtccgacaccgtgaatctgcacgtttttcccgccgatcagtcgtgacagcgggttcagaacgatcaagtccgctgagctgtaaatcgatgtatataaaatcttttggttcggatcagtccccggaagcgcccggttggtcacaaggccgttcgctccgccgagtgtgacgacgttggcgattttgtctccgccgtcaagatttttaatgtaatagagcgtgttggcgccgcccatgctgtgcgcgacgatatcgacttttttcgcacctgtttcgctgagcacttttttcacgtaattggacagtctcggcgcattgtgtctgttgtttccggttttgtctaagaaatcaatagcgtacatctcttttcttgaccagccttgggatgccaagtatgttttgattcccgcaaagttaaaagacgccccgccgattccgtgaaccatgactacagggttatgccctgaggaggctttcgatacggtcggctggaaggcaaatacggaaatgacggacagcatacaaactgtaaggatgactaggattttgctttttatatgtttcatgaactttcctcctgctatgtaatatttttgcagttttcattctattagagaagaaaaggaaaaaatagtgtattttttactgttttcaacaattaaaaaagagcggaaaaatgagaaagacgcccctttcccgaaagcacgcttatgctttaatacggcataccgacaaaggagagaacacccggttctctactcctagtactcattgaaataggtttgaatccgcttaggatcttgcgtttttgtcagcgcgagcatgagaagaatccgcgctttttgagggttgagagagtttgaagctgtcaaatggtctttttcatactctcgattaggtgttaccgccccgtttcccgtccttgtggagcggacgaccgccagcccgcttttgaccgactttacagcgccttttagcgccgcatcagacattgagccgtttcccgggcctgcaaaaataatgccttgcgcccctgattttacggcggcttcaaagagatagcttccgtcattttgatagccgtatataatatcgacctgcggcagtttatcaagtttatctatcttgaaatctgtatccttcgtatgctttcgggtgatgatgttattaaaatagacgtcatcagcaattgttccgatataacccatttcttccgatttgaaagtgtcggtcgcggttgtattggtttttgtcacataacgcgccgaagcgattctgtcatttaatacgacaagcgtccccttgcctttcgcctcaggcgcagccgctgtttttaccgcgttatataagttggacggcccgtccgctccgatcgccgtggacggccgcattgacccggcgacaacaacgggtttgtcactcttgaccgtcagattgagaaagtaggcggtttcctcaagtgtgtctgttccatgtgtaatgacaatgccgtctgtatcatcagacttgagcagcttgtttacccgttttgcaagtttcagcagtgtctcgttattcatattctggctgccgatattcacaacctgttctccgctcacatgcgcggcctcttttatctccggaacggcctgaatcagggcatcaactccgattgcccccgccctgtactccgtagcggacgtctttgaaggagcagcgcctgcaattgtgccgccggtggcaagaattttaatattcggaagtccgtcttttttcgcagaggctgcggctgccatctggggcggtgtttctttcgtttgaggagattgggagcagccggccgcgatgaagagcagagccgtgataaatgtaatgaagggcatgaattgttttttcattcttttctctccttttctttatttatgatgattttcctctcaccggtcaacgcgcttgtcaggcattcttccgaagaaaataaccgttaaaaaaccttgacaccgtcatgcgaaatcaagataatagaccagtcactatattttaaatttgtcacaaatcagtaaggtgggaacattatgagctatggagattctcgggaaaaaatcctcgccgcggcaaccaggctgtttcagcttcaggggtattacggcacgggactgaatcagattattaaagaaagcggggcgccgaaaggttctctttactatcattttccggacggcaaagagcagctcgccattgaggctgtcaatgaaatgagccattatatccgtatgaaaataaaagaaagccttgatgctcatcttgatccggcggaaagcattcaagcgtttttacaggacttatcaagccaattcacatgtccggagaattttgaagggtttcctgtcggtttactggctgccgagactgctttaaagagcgaaaagctccggcaggcctgtcaaaacgcttatcaggaatgggagaatctgttcgcgggcaaattaagatcagccggtttttctgatgagaaagcggcggaaatcagcactgttttaaatgccatgatagaaggcggcatcattgtgtccttagccaaaaaagacaaaatgccgatcctccatatttctaaacaaatccccaacctgctgaagacataaaatacgagagacatgtacgtatagaaagagaggagaatgattttggaaaacgctcagccttccaaacaatataaagtcatgccgatcatgatttctttgctgacggcagggtttatcggcatgttcagtgaaacggcgctgaatatcgccttgactgatctgatgaaggagctacatatcactcctgcgaccgtccagtggctgacgacgggctatctgctcgttctcggtattcttgtgccggtatcgggtctgcttttgcaatggtttacgacgagacagctgttcatcgtttcactcgctttttccattatcggcacgctgattgcagcgcttgcgccgagctttccgtttcttttggcggcaagaatcgtgcaggctttaggaaccgggctgctgctgccgctgatgtttaatacaatcctcgtcatcttcccgccgcataagcgcggagcggcgatggggacgatcgggcttgtcattatgttcgctcctgcgatcggtccgacattttcagggcttgtgctagagcatttgaactggcattggattttctggatttccctgccgtttcttgtgttggctcttttattcggcatcgcctacatgcagaacgtgtctgacattacaaaaccgaaaattgacgtgctttccattattctgtctacgatcgggttcggcggcatcgtattcggattcagcaatgcaggcgaaggatcagacggctggtcaagcccgacggttatcggttcgctcactgtcggcgcgatcgcgctcatcttattttccatcaggcagctgacaatgaagcagccgatgatgaatctgcgcgctttccgctatccgatgtttgttctcggtgtcgtgattgtgtttatctgtatgatggttatcttatcgacaatgctcctattgcctatgtatttacaaagcggactgatgctgacggcgtttacgtccgggctcatcctgctgccgggcggtattttaaacggctttatgtctccggtgacggggcgtctgtttgataaatacgggccgaagtggcttgtcattcccgggtttgtcatcacggcaactgtgctttcgtttttctcaaacattaacggcgcttctacggcgcttctgattgtcgcgcttcatacatgcctgatgatcggcatttccatgatcatgatgccggcgcaaacgaacggcttaaatcagctgccgccggaattttacccggacggaacagccattatgaatacgctccagcagatggccggcgcaatcggcactgcggtggcggtcagcatcatggctgccggccagaagaattatatgagcaccgcgaaaaacccgaatgatccttccgcatactctcacgcgctgattgcgggcgtccagcacgcctttatctttgcgatgattgtcgccgttatcggcttgatcagcgctttctttatgaaacgggtcaaagtgaatcattcataagaaaacagcagactccccgtgagtctgctgtttttttatataccgcgcgcttcagccagttcatcaatcgcatagatcagatcgtcagctgtgttatagaaatgaggcgccagccggatgatttgtccgctggatgcgcatacgatgtttttccgcctcaacagcgcagccgtttccgccgctttttcatcccgtatggaaatcatgccgggtctgtcatcggcagacggcggccctgtgagattcagtcctttttcagaagcgtattcatacgcaaatgcgctgagtttttttacttcttggtgaatgcggtctgtgccggcatcgtttaatagagataaagccgcctgtgccgcatatatgctgataaatgccggggttccggtctcaaagcgtttggctccgtccgcataagaaaaacgggttaaatccggcatcgacgcccgctgctgcccgaaccatccggtgactttcggcttcagccgttcggcaagttcctttctgacataaagaaacgccgttcccggtatgccgagcatatactttctcgcacccgcggccagcatatcaactccccattcttttacatcaatcgggatgtgccccgccgattgataagcatcgacaaaaagaagcgatcccttctttgcggatatctcggcaatgcgctttatatcctggacaaaacccgacgtatatgacacatggggcacacaggtgaaaagcgtctgctccgatatgtacgtctcataccgctctaacgggatcattccatcttcagacggcacgactgaaagctccatctcagtctgtgccttcaaaatgtgggcgatcgccggaaaatccaattccgtatacaccgcctgtttctttcggcaatccggtaaagcagaaacgacggcagagacagcagccgttactgaaggtaaaacggcgatttcttcaggatgggcgccgatcaattttgcaaattcacaccttgcctgctccgtacgtccaatggcttcttcccagtttccgccatgctgaaacaggctttcctgatagtcattgaccgcttttgaaaccggcagggcaagagcgctttgagagcagctggcgagcatcgtatgtgtgcggagcaccggaaataaagatcggtattgcaccagaggcgaattcaagacatggttcccccttcggcaggaatatatgtccattatagagtatggtaaaaagaaaaggagggttttatatggagaaaaaagtattactgacaggctttgaccccttcggcggggaaacggtcaatccttcatgggaagcggtcaaacggctggacggttcccatgaaggccctgcctctatcgtatccgaacaagtgccgaccgttttttataagtctcttgccgtgctgcgcgaagcggtcaaaaagcatcagcctgacattatcatttgtgtcggacaggcaggcggcagaatgcagatcacgccggaacgggtcgcgatcaatctgaatgaggcgcgcataccggataacgaaggaaaccagcctgtcggggaaaacatttctcaaagcggtcccgcggcctattggaccggccttccgatcaaacggatcgttgaggaaatcaaaaaggaaggcattcccgcggctgtatcctacacggcggggacgtttgtatgcaatcatctcttttacgggctgatggatgaaatcgcctgccatcatccgcacatccgcggcgggtttatacacatcccgtacattccggagcaaaccttgcagaagtctgcgccgagcctcagcctggatctcgtgacaaaagcgctcaaaatcgccgcggtgaccgccgcggcgcatgaggacgatattgagaccggcggaggcgagcttcactaagcggcagacacctcggcccatttcttccggtaaacgatgcgggacagcgtcacactgatttcatagaggacgagcagcggaatcatgacgagaaagtcagacataaaatccggaggcgtaatcagcaccgagacgacgatcagcaaaaaatacgaaagcttccgcgcctttgccagccgggttggattcacgattccgagccgtgtcagaaacatgacggccagaggcatttcaaacaaaaatccgaacggcaatgtaagattcagcataaaggtaaaatacttgtccgccgtaaataccatgtcaaaatggccggcggataattgtgttaaaaatccgagcacaatcggaaacagcacaaaatacccgaaggaaattccgataataaacaaaagcgaaagccccggaatgtaaagcaaagcggcgcggcgttcgaacggggtcaaagccggcgccgtaaaacgccagagctgaaaggccgcaaccggaatcgctgccgtaagggcgcatattcccgcaatcatcatatacacccataaaatctcgctcggccctaaaacggccagcctgccatgcaaatccttgatcagccagtcataaatatcctgcacaaaccagcaggcgccgataaaaaacacgagaaaggcgataacgattttaatgagacgctgccggacttcctctaaatgcccgatcaagtgggtttcttttttatccaatcgtacatcctccttatagagaaagaggcagaagcggattcgtctgcccccatgtcaggattcagcctgccgttttgtctttctcagccgtctgcttgtccggctcttcatttgagaccaatgtttttgcggcgcttttaaattcaagcagcgtgcggccggcggcacggccgatttccggaagttttgaaggtccgaaaatgatgagagcgatgacgaaaatcaggatcaacccgggaatgccgatatttgaaaacatgagtgtgcctccttattgtgagattttggcccgtttctttctcatttgcttttcatgcgcattgttatgggcgaagaaacgatcctcttccacctcgtttgactgctttaaaccgcctgcaaccgccgcttgagagaccttccgaatccccgtctggtctttctgataaatgaatgaagcccgcgtggatacctcagcccccggctccgtcacgtacggcaccactctgtaatccgctctccattgggcaggagtcaccgtacagcggacatagccgcggtaatcgttgaaaaacttaatatgcgggttttgttttaagatctgatccgtatcggcccgtttatccgccccgtttcctccagatgtaatggaagtcccgacgaattcggctccgaaaatttttgaattcgtttgattaaaatcggtatgcaggtttgacgcccagcttgcatgaacatcacccgtcagcacgatgacattgttcaggtttttgctttttataaaattgatgacccgctcccgctgagccgggtagccgtcccatgaatccatgctgtatatcggattggcggttgttccgaaattccattgcgcgaaaaagatttgctgcgccagcacattccacttcgcttttgaggcggctaaatttccgaagagccattgctcctgctctgtccccatcaatgtgcgcttcgggtctctccactcatcagaaggcggcttattcccgtcgccgttggcctgatcatctctgtactgtcttgtatcaagcacattgaacgatgctaaattgccataagaaaattgcctgtacagccgcatatcaggaccgttcggcaatgacatgcgcctgagcggcatgtgttcataataagcctgataagctgcggccctcctgagcacaaacgcttcaacggattggcctttttcagggataacattggcataattgttttccacctcatgatcgtcccacgtcacgacccacggaaatgcggcgtgggcggctttcagattggcatcagagcggtattgggcgtgacggttgcggtaatctgacagtgtgtacacttcggcgctgctgtgcgtcctgacatttcccgtttttgacacatattcgttcggtccgtattcataaatgtaatctccgagatggaatacgagatcaagcttttccttcgccatatgtttatacgccgtataatagccgtgttcatactgctggcatgaggcaaatgcaaacgtcatggccgatacgtcagcgccgggagcgggcagcgttttcgtccggccgacggggctgagctcatgcccgcttttaaaccggtaatagtacactttattgggcttgagcccgtccgcctcgacatggacggagtgtccgagattcggcttggccatttccgttccgcgtttgacgatgtgacggaaatgttcatctgcggcgatttcccattttaccggcacggcctgcttcggcatgccgcccccattcagcgggtcaggggcaagacgcgtccagagaatgacgctgtcagacagcgggtcgccggaagctacgccgagggtgaacggatagtttgaaaatttcggagcggcattcacttcaaacgcgccgatggattgcgcgatcgctaacccgagggaaagaccggcgattttcccggcgccctgtataaatgcgcggcggtcaaacgtattgttctgaaagcttttgttctccaattccttgatccattcatctaaacggccgtcatgtgtcatgtcagttcccctttcgtcttattgatcgcccttattataaaaaagaaatgttaaaccgctatgaagaagtgtgaagggtttgtaaggctgaaaaatgaacggcgggagacatttttcacattgtttcgacaaaccttgccccgccggaagaaaaccccctctgtttctttttggcttgtcatccgtcaagcgcacttttttcctatttttcttcacaaaacattaaaaaaacaccgttcattttaagaacggtgcccccgggattaaaatgtattgtacacgttttcgcacgtctcacctgtcggctgatagaagcagtgggatctgaatctggcgacaaacggctggccataccaagtctgcgggcagttgcccggcggcttaaagtaccacagactgaacttagccggccaaaaccgttctccgttaatgttcctgcgggcaagcctccgctcggattcacgcggtctctggtaaaagtatccgtgagtcaccgcttcaaacgcgtgcggctgaaacaccatctgcctgatggtgcgcaggcctttaaaatcagaacaattcgcccgcacccgattgattcccacattgccgaccaaaagcattccctgcttcccttcgccttccgcttccgccctgagcagccttgccattagatcgacatcggcgctcgacgcttttacgactgccatcatgacacctcccgtattttctcctttcatcatattcagcagcggcccagtgatgacagccaaaagccagaaaacaaatgttcacgaaaaaagggtttatatttcacgttatgaggaaacatactaacatgatttccataaggaggaattcgaatggaacacattaaagcgcttgccattaaaggcattatgaccatcattattctgtatctgatactcggcttaggttttcgctttacattcggtgacgtgctgctgatgaccattgtgctgggagccgtttcctactttacgggcgacctgtacgtgcttccgagatggaataatatcacggcggcgtccgctgatttcggaatcgcgtttcttgttgtctggctgatgggaatgccgctgtccatgggcatttccggaggaagactggcgtttgccgctctcatttccgccgtcatcatcgccgtcggagaatattttttccatatctatctgatgagaaaagacttgggagggtcccgttttttagaaccccggtccgaataatgtaaaaaaggccggataacggccttcagcttgtagagaaaatgatgttttttctgcaagcttttttgttttttgctgtttctttacatatgcccagccttgcttggctgggtatgcggcaaccttcaacatcattttgaataagatcagcggatcaagtgaggggcggcctttattttcgttgcagtaaggtttgaccttttcaacgataaaagagaagtctatgtactgatcaatttttcgaagcaggtgatcctcttcaacgagttggtcaaacagaacgaattcggctgtattttgagaagcgtctcttgtgcgggtcttttattatatgacaggggaatggatattttaagggaaaaataaaggctgtcgagattttctagacagcctgagccccttaaagggggctttttatttgtaaagtaacgctttatacatcttgatataactgataaacccttttcagccttttttcgagctgttcaaaatgaacaaagcgggcttctctcagaaactcagtcccatcaatgaacaaaagaagcacggggacagtgaagactgaaaatctgccggcaacctcttctacctcgtcagcgttggtatgccccaatttgatattcggaaactgatccaaaacttttctgagctgcggcagaacagcgtgacatactgtacaggcaggtcttgaaatgtagataaaactgaattgatgctgcttaataaaattctcgatagaatctaatgaatgtaagtctgtcagctctttcatcaaaaccctccttcaaatcggctcgtctttcatgaccaagctcatcaatactcgtacattcactatacacatttatattgatcatatccgcttttttgcgattcagagcaccttaacgtcgtgcttgaaaaataaaagaacagttaccgcttttcagtaactgttcttagatacttatattaaaaatgcaaagcgtaagctcctgaaccgatgagtgcaactccgatggagactgcaatcagcaccacgttatattcaaaaccgccggcaccgttcgcaaaccctttcgctccatgaacttttacaatggcacctaacataatgatcgttatgatagcagctccaagcgggaggaatacacctaaaataaataaaattccgcttgcgagttccccgagacctgataaagcggccgcggcattgcctggtttaactccaattgactcgaaccattgtccggttcctttaatcccgtatccgccaaaccagccgaataatttttgtgatccataaaacagaaacaccacaccaatcatgattcgaataagtaatagtcctgcatcttccatttttatctctcctcatctttgatttcatctgattctttgctggacggtaccatccagcaatcatcaattgactatatgtttctttattttttatgtgtcaaatcaatctaattctcttacttcaaacggcagcagcccttgttcaatttgtgcccggtgcggttcatactgctcagggagcatcaattttccgcccattgtttcttgtgactcatcatgggcaaagcccggcggatcagttgcgatctcaaataagatttccccatgttctctgaagtaaaccgcattaaaatagtttctatcctgaacaggagtcacaccatatccgtgcgcagcaatgaatctttgccaatctaattgatcttcgtcatcctgagcccgccaagcgatgtgatgcactgtgccgacacccatttgtccgcggccgatcggcgttaatttaagatcaatcacattcccgatatcaccggcagaacgataacgaacgaagtctccttccttgccgactcgctcaagccccatgatgttttccagcagttcacctgttttttcaggctgtgctgataacagggttgcaccgccaaagcctttaatggcaacatccggggttacatctccgaaagtccacgtattggcctcccctgcttctctttccacgatttctaaatgcaggccatgcgggtcatcaaattctatatattgttccccaaaacgctcgatttttgtgtatggcacgttgaacttttcaagtctcttttcccaaaacgccatagcacctctcggcacgacgtaagatgtcacgccaacctgtccgtctccaatgatgccttgacgggcgtccgcccacggaaagaatgtgatgattgttcccggcttcccgccttcatccccgaaataaaggtgatacgtacccggatcatcaaaattgaccgtttgcttgaccaatcgcagccccagcactccagcgtagaaatcagcattctcttgagggtggccgacaattgctgtaatatgatggattcccatcgtttttttagccatttttatgcgctcctttataaatatttaaatatactccacaaactcattcacaggctttcggtagccgcgcggccttctgctttctattttttctttcccgattgtaatcatcatgacgacctcaaattgatcatctatattcaaaatctgtttcacggcttcaggatcaaaccctatcatcggacaggtgtcccagcctttttccttagcactcagcataaacatcatcgcagaaagtgaagcatttcttatcgcctcatctctcttaaacagttctcccctgttttcataaaacgaaacggtgttttgaaccatgtgatcatactcttgtttatttaatacccccagcaccttcaatccttcatagatgtcagccgcttgctgatatgcctgcttatcccctaaaaccaaaagaaccgctgatgagctgaacactttatattgtccgtttgcggcctgcttcagcttttcttttacctccgggtcaagaaccgtcacatattttgtatgctgcaaattaaaagctgatggagccaacgcaaccaattcaaacatttcgttgagctcatctcttgtgattggatgttctggaagaaagttgcttgcagatcttctttcattcaccagctgtacaaattcagccatttctctcgcactcccctttatctcgaattcgagatattatggtataaaaaatcaaataatgtatgatcaaaaaacaaaacgatcggcaggttcttatcctgcactctaattaaattgtctcgaattaaaatatcttgaattcaggataataataaaagataaatactcaaatgtcaacagttcatttttaaattcagcgcaattttgtttatgtactatttagccctgctccaactttttttctgtcaccttatttattagtaaacaggaaacaaccttgctatagacccactcgaaactgaattgatatgataagcaaagtgattacacaagaaaggatacggagagcgaatcaagagcgctcctatttttttgtgcagttttataggaggaaaaaatgacaagtgaaagagaacaaataagcaaaaaagttgctttgattgcattgatagccaatctgatcttaatggcaggaaagatcttttttggactgataggcgatagtgaagcagtttttgccgacggtatacattctgcagcggatgtcgtggcttcaattgctgtcctggccgtcatcggcatttctaataagccgcccgatcaagaccatcctttcgggcatggcaaagctgagatcatcagcgaagcgattgtaggaatcatattagtgctcgtttccgtgtatattctgatagaagcgatttcgtcctttgttgaaggtccaagcatcccgcaatacagcgcattgtttgcggctctgatatcctacgtggctaagcagatcttatatcgttattcgatcaaacaaggggaaaaatggaacagtaaagcgattatagcgattgcatacgatcataaaggcgatatcgttgcctctcttgccgcttttatcggcgtcctattggcgattatcgggaacacacgcggatggtcctatctgttgtacgccgatgcaattgccagtgtcatcgtggcgtacctcatttttaagatttcaatggaattaatcaggccgtctgttgacgttctcatggaaaaaagtgttgatcccgaactgatagaggaatataaagcggttattttggattgccctcaagtcaaacggctcgataaaatccgagcaagagaacacggccactataaattgcttgatgtccggttatctttggatcatgatttgacgattaagcagggacacgatatagcccgggaaatccgaaatgaaatcaaaagacacttttcagatgttgaagaagtgctcatccatgtgaatccttattttgaagaatgaaaaagcagcttgtagagaaaacgatgttttttctacaagcttttttgttttgtgctgtttctttacatattcgtttgatttcactgatccatatgctttctgataaaatgcagcagcgtgtttccttgagcggtcaatatgacgcccttcgcgctgcacttcggacagggcgtcccttctttctcctcgccggttccttcacaatgcggacatgtgagctcaagatcgtcggttgcgatcaccatgaatatccctccttttttgattgtctgtccgtctccagtcactttccatggccatcacctccttaacaacgcaaaaaaaccccgtccatcaaaggacgaggttttcgcggtgccacctttattaacggctgaagagccattctctcaaaaagtacagaaactcagggtttcaatactcctatcttgataacggggaaagaatcccggcaccgcctactgttatttcagcgcagcaattcagaagcccattcggcaccggacggggatcggttcacagcggccaccgactctctgaaccccgcgcgctgatgcgtacttactcttcctcagcattgttcatccgttctatgattttaaaatgtatcatacgctgtcatccggcggaagtcaataacctttcggatcggacagtccgagcatgtcccgcgccatttgcatatgctcctcttgccccgtctgaagcgcgaacttcgccgtttccacagggtaagcggcctgccattctgacacatgctcctgcattttcggccagacgcgcccgccctcagcttcgtagctcttcatcagccgttttgtttctttttctcctaatatcacttgataaaggacaaaatccttggccggatcggcaacctttgcctccgtccaatcgaggagacccgtcacacgctgattttcgccgatcaaaatatgcggaggatgcaagtcgccatggatcagcgcagaaaaatcaggccagtacgagctgtcatttatccacgtttgccatcttttccaaagctgttctgaaaccccgatttctttttttatatgatccattgattccgccgccctttgcctgacgtcatccggttttatgatttcaattccggatctggaggccgcatccgtgtctgccccgtgcagcccggctaatgctgcggcaagcgagccgacaaaaccgtctgaaggcggctcgtgttccatattccagacatactgtttcttatccagatcaattgcggcagccggtattccgtccagtttcggataagcgatcagttccggtgtatgaatccgccaatcggggactgatacagcggcatggctgcggagaaacgcgagaacatcgctttctgcagccgctctttcgataacatcgggacggcgcggctttcggagcacccatgtcacgccgctgtcatcttcagcaaatacgacttggaagtccatacccgtttcatttatgtccgccccttcatattttaaccgtaagccattttcctttgcgatgttcaaaacggattctatttccctttgtttttttgtcatcttgtttccccatttcccttattgactgacacagagcttcgcctttaggcggagaagaaagagatgtgtgaagacgccaaaaagagggcggcataatcgccgccccctcactattactgtcaggttccttattcaggcagacaatcccggtttcctccgcgctcaaggcagagactttgacactatttcattagtgcgaaaaccggaatttgatcagccatcaggatccctccgttccttcttagttaacattattttacacaaaaaccttatatacgtaaaccctatttatcagcttaccggctgcctccgctgacaaattttgatccttcgcgtaaatctttcgcctccaaaaaaaagacgtgaatgaattttttcatattcactttaaccggagaaagcggcacggtttccttggcctgcatttctttcattctcttgctgacagcggggaaatcaaagaatttcgaggcgtaatattcaaatttggggtttgaaaaatcagttgtgcccaatgaagcgaaatggtttaacgaatgaatgacggcccttctgatccgctgttccgaggctttgatttctctgttaacctcggcttgtgccgccgcaggtcccagcttccggatggcggcgtttgtaaacatctgctttaaagacgggatgtttctttccgcctgttcatcctcaaataaatagtgaaggacggccatgaggtcatgcgccccgctttctcccacgatgcctaattccgacaaaagaaattttcctgtttctttgattgatttctcgtgcatcccccccggcccgctttttttcggctcattccgctgaataagacggcttaacgagtgttggatgtcgccgatcgaggtttccagttcaatccgctcttttacttttcgcaaaacggtgacgatctcgattttgttgatcggtttatggataaagtattcgatgccgagagaataagcttctcccaccatttcctttgcctccacctgcgatatcatcactgcttttccgttgtacgccccctgaagatgccgtatcgtctcaatcccgtcccggcccggcatcagcagatcaattaataaaatatcgacttgtttgaaatggagataatgcccttcaatctggcttccgtcctctgcctcaccgacgacttctcctaagtcctcgtcctcgatcatctgttttaaaatggaacggatcgcccggtcatcatcagctataaaaaaacgcatattatgagttcatcctttctgcaatcaaatgcttcaccggcagcttaatcgtaaatatgacgccttttggcttgttatgaaaggaaatgtctccgtcaagttcggttacgatttccttcacgtatgaaagcccgatgcccgttgaaggtgcgccgaattcatcgtatttggacgtaaaaccgggatcataaacgacctctccgattttttccggaatgccgggaccgtcatcttccgcctcaaattcggccatcccccctccgccctgcgcagcgcgaggcggatctcacccctgtcacccatggcttcgacggcattggcggtcaggttatttaagatcgacaggacggtaaagacgtgataatcggggtgttctccttcaatcacgtttttgaattgaatgtctttgcctaaagattcggcgtatttttcattgatgcggataacgaggccgaccagatcggcggcattcatgtaatcccggaatctctcatttgaaatcagcttcgacaggccggcgaatattcgctgattgtcttttttcacttcatgaatttctcccgcaaggcgcagcattcggctcccgagctcccggtcgttcccgctcatttcccgatacagctgataggattctttcgtcacatgctccgtcgttttcagcgtttttttcagatgaatcgtttcttcatataagttagacacaatcatcagcatgtgctcatgctgctttctcgtttgtttttccctgacctgagattcgtgcagcttcatcacgttgaaaaaactcagcacaataaatgtgtgagaaacagcgataaccgcaatatccgccagcttgtccggcatcataatctgcttgccgccggaaaactgaaccgtcatttcaacggcatcggacgccatttcaatgagaaaaccgagaaacccgatcatgagcggccgatcccaaaaaagcctgaccttcagcacataaaacaaacaggcatatgtaaagtaaaaaaagaaactgggatattggctgaaaaaagccgccgtaaatccggcatgctctccccccagcacgccaggccgatccggaatcccacaacggctgcacctgtcaacagccctgacaataccgccggcacatgccgaagcagcagaagaaaaaagaaaaaagccggggcgccgaagctgatccgatatacctcattcagggggtaaaatttcagttcccccgccagcggcacggtgatcagcataagagcgaaaagatagccgtcttttttcagtaaatagtcgagcctgatcataatcacttccttcttctgtctattttgaacaagaccgatacagtccgcaaatttctttagacccgaatggcgggacactccggctgatttataaatctatcggcttattttaagaatgattttgtcgtattttgtatgattctgtagatgtcattatacattaacatggaacacgctatttttgaaaacgttttccaagaccggtttccgcttcggacaggcttgcaatagaggaggaatgttatgaaagatatggtcagagagcgccttgaaaaagaggaactggcttcacttttacaagattgggtcgagcattaccgaccgttttccgtcaatggaaaaagcgcaaattatatacccgccctcggagaaatcaacgactctcagctgggcatttgcatattagagccggatggctcaatgattcatgccggtgaatggaatgtgccgttcacattgcagagcatctcaaaagtcatcagctttattgccgcatgcatgtccagaggcattccttatgtgctcgatcgtgtggacgtggagccgacgggtgatgcgtttaattctatcatccggcttgaaatccataaacccgggaagcccttcaatccgatgatcaatgccggcgccattaccgtcgcctcgctgcttccgggtgaaacggcgcataataaattagaatatctcttttccgtttttgaaaaattaataggaaaacggcctcacattcacgaggaggtcttccgttctgaatggcagaccgcgcatcggaacagagcgctcgcctactatttaaaagaaacgaactttctcgaggcggatgtggaagaaacgcttgaagtgtatttaaagcagtgcgccatggagggtacaaccgaggacatcgctttaatcggattgatacttgcccatgacggctaccatccgatccgacgggaacaggtcattccgaaagatgtcgcgaaactcgccaaagccctgatgctgacgtgcgggatgtacaatgcgtcaggcaaatatgcggctttcgtcggcgtcccggccaaaagcggggtatccggcggcatcatggcattggttcccccaagcgccagaagagagcagccttttcataacggatgcggcatcggcatttacggtccggccattgatgaatacggcaacagcctgaccggcggcatgctgctgaaacatatcgcacaggagtgggagctcagtattttttaatcaaacgaaccaagaggtgattggatgcaggaattccttgaaaatgtaatcggctcggcaaatgattttttatggtcaaaactgttaatcgtactgcttctttctctgggactgttttttacgttcagatcaaagggtctgcaagtccgcatgctgaaggaaatgatccgggttttgaaggaaggcgcggccgcccggacaaaaaacagcatttccccgtttcaggcattttgcatcagtatggcggcgcgtgtcggaacagggaatattaccggaatcgccattgcgatcgcactcggcggtccgggcgctattttctggatgtggattatcgcagtcatcggttcggcttcaagctttgttgaaagcacgctggcccaaatttataaagtaaaagatcaaaacggattccgcggcggcccggcctattacatggaaaaaggcctgaagaaacgctggatgggcgcgctgttcgccgtattaatcacactgtcattcggggttgtttttaattccgttcaatccaatacgatcagcgtcgcctttcaaaacgcgttcggcaccagccggcttacattgggcattattttaatcttggtttttggcggcgtaatcttcggcggcgtcaaacgaattgcgaaaatggcggaatacatcgtagtcgtcttggccgttttatatatcggtgtcgctttctttgtcattctgacgaatatcacccaattgcccggcgttctgtcgctaatcgtaaaaaatgcgttcggcattgatcaggcagcgggcggcgctttaggtgcggccttgatgcaaggtgtaagacgcgggattttctcaaatgaagcgggtatgggaagcgctccgaacgcggcggcgacagctacgacgagccacccggtgaaacaggggctcattcaggcattcggcgtcctgacggatacgctcgtcatttgtacaagcacggcgcttatcattttattttcagacgcttatcaccagccgggactgagcggcatcgcgctttctcaggccgccttgagcgaccatgtcggcgcgtgggcgtcaggtttccttgccgtcttaatgcttttgttcggcttcagcgctctgatgggcaactattattacggagaaaccaatatcggatttttaagccagaacaaaaagtggctgttcatttaccgcatctgcgtgctcggaatggtactgttcggctgtatttccaaagtccagcttgtgtgggatatggctgacttgttcatgggcttaatggtggtcgtgaacttaatcgcaattttccttctgtcgaaaaaagcatttgccgctttgagcgattatgcccggcaaaagaaagccggaaaggaccccgtcttttacagagatgtgctccctgatgacgacgggatcgaatgctgggagtattcagatatcgcgaaaagcgcgaaaggcaaacatatttcctaaacaaaaggtgttcaggcagcgtcctgaacaccttttttccgccggttcattgacaaagagaatagcgtccattaccctttttatatattttcagtaaagtcagaaaggaaggcctatgaatcccattacacaaatattaaatgaatacccggttatgatcatagacggcgcgatggcaaccgagcttgagcggatgggctgtgatttacatgacgatctgtggtcggccaaaattcttttggagagacccgaactgatcaaacaggtgcatgcagaatattttgccgccggcgctgattgcgcgatcaccgccagttatcaatcgacaattgaaggatttgcagcgcgcggcatcccggaaaccgatgcgatacgtctcattcagacatctgttgaacttgccgcacaagcacgcgatgaattttgggcgcatgaagaaaaccgtttacaccggcctaaacctttggtcgccgcttctatcggaccttacggcgcgagcctcgctgacggctctgaatatcgcgggcattacggactgacggaagatgagctgatcagctttcaccgcccccggatgaaagccctcatagaatccggcgccgatcttttggcctgtgagaccattccgtccctgtcagaagcaaaagcgatcacaaggctgctggaggaattccccggcacttatgcatggatcagcttcagcgccaaagacgggcggcatatcagcgaaggcacgcctatttccgaatgcgcggccctgcttgactcctgcagccaaatcgcagcgatcggcatcaactgcacaccgatcgaatatattccgccgctgatagaagaaatcaaacgggcagcatccaaaccgattatcgcctatccgaactccggcgaacaatatgacccggtgacaaaaacctggaaaggcgcagcgtgcgaaaaccatttcggaaaaagcgcgcaaagctggtacgaaaacggcgtgagcctgatcggaggctgctgccggacgaaacccgcggacatccaagccattgccgattgggccaagaccttaaaaacaacttgactaatcggaatagtttgtatattctattcaaaaagccggttcgccggaatctcgtgccgttcgccggcatgagattttttattagaacggccctcgcagaaagttggaaaacaatgaacaacaagaacgagacgaattttcagagaagtatgaaaagcagacacctctttatgctatcactcggaggtgtgatcggaacggggctgtttttaagctctgggtataccattcatcaggcgggtccggcgggcaccattttcgcttaccttttgggcgcgggcatcgtctatcttgtcatgctttgcctcggtgaactgtcagtggccatgccggtgacgggcgcattccacacctatgcgaagacctatatcgggcccgcgacgggctttacggtcgcatggctgtactggctgacgtgggcggtggcgctgggctctgaattcacggcggccgggctcttcatgcagcgctggttcccgcatacttcagtttggatgtggagtgcggtattcgctcttttcatctttttattaaacgccttctccgtgaaattttttgctgaatcggagttttggttctcaagcattaaagtcttagccatcttactgtttattttattgggcggagcggcgatgttcggcctcgtcccgatgaaaagcggtgaggccgcacctatgctgtcgaactttacggatggcggcagcctttttccaaatggctttttcccgatactgatgacgatgctttcagtaaacttcgctttttcagggacggaattgatcggaatcgccgccggggaaagcgccgatccggaaaaaaccgttccgcgcgccattaagaccacagtctggcggctggcgcttttctttatcggaacgatttttgtgctgtcagggatgatctccatcaaggaagccggtgtgattgaaagcccgtttgtcacggtatttgacagagtcggcgtgccttatgcggccgatctgatgaatttcgtcattttaacggcgcttctgtccgcggccaattcagggctgtacgcgtcatcacgtatgctgtggtccctgtctaaagaaggggagcttcatcccgcctttgccaggctgacctctaaaggcattccttttaacgctctgatcttcagtatgatcggcggcattctgtcgttgttgtcaagcgtatttgcagcggatacagtctatcttgttctcgtctccgtctcaggatttgcggtagtggctgtgtggatgagcatcgccgcatcacaatttttgttcagaagacgatttcttaaagaagggcaccagctttcagacttgaaatacaggacgccgggatatccggccgtaccgatagcggcctttctcctatgcctcgcctcctgtatcggcatcgcttttgatccgaaccaggccatcgccctttattgcggaattgtatttatggccgtttgctacaccgcttattacttgaaaaaccggaaaagcagagcccgcgtgcaagccgtaaaatcccaataaccaaaaaaagaaccctgcggcgcaagggttcttttttcatttatacttcaacgacccatctgaacgaatcccgcaccttcccgacttggatgccggcaatcgtttcatagagcttttctgacacttcaccgatcaaaccgttattcagctcaatcgtttctccgtgaatgtgcagcgcgccgaccggcgagatgacggccgcggttcccgtaccgaatacctccgacacctcgcctctcattgcagcctcatagatgtcatcaatggcgacctgttcttccctgacacggatgccccagctttttaacagctctatcacagatgcgcgtgtgatgcccccgagaatgcttccgtttaacgccggcgttacggcctctccgtttatgatgaaaaagatattcatactgcctacctcttcggcatatttcttttccactccgtcgagccaaagcacctgatcataccccagttcttcggctttccgctgagcctgtaagctggccgcataatttccggacgttttgacgtcgcccactccgccggtgacggcgcgcacatactcatcctccacataaatacggatcggtttcagctgatcgccgtaatacgaaccgaccggcgtcaaaacaaccatgaacttgtaacgctttgaaggccggacgcctaaagaaggctcagtcgcaatcacaaacggacggatatataaagaggttcctttttctatcggtatccattcctgctccagctccaccaattgtatcaatgcttccagcgccagcttctcgtcaagaggtggcatgctcatccgccgtaacgatttattcagccgttttatattttggtcaggacggaacatcaacacccgtccgtcttctgacctgtaagccttcagcccttcaaatacggcctgcccgtaatggaaaaccgatgcggaaggatccagatggaccggttcataaggtgtgattctcggatcatgccaccctctcccctcttcgtaatccatgacaaacatgtaatctgtgaagtacttgccaaatcccaatgaagcggaatccggtttttcctttctagctgtgaccttacgtctttcaatcagttgattcaacaaaagcacacctttcttctaattgttcaaattttcagtcttttctgggctgcatgttttttctgtcccgaatcttgtatgcacagatatatgagaatgcagttgaccatatcatatcaaatataccacttataagaggataattatcaaaatttttaatattttcagcggaaatctttctttattcttatgctccttcatttttttcaatgaggactttctgtcatattcaatgattgcgcttacataatgtaaagcaatccttcctttcgcacagtcaatcatgtgacaaatttatggcggacaggaaggtggttgccgcctgcttcacgaattacgtaagaaatgcgcaagtaaaagggggattcgcttgaaaaaatttatcgcattccagattttgatcgctttagccatcggagcattgatcggccatttcttcccggatttcgggatggcgctgcggcctgtaggagacggatttatccgcctgattaaaatgattgtcgtgccgatcgtgttttcgaccattgttatcggagccgccggcagcggcagtatgaaaaaaatgggcagtctcggcatcaaaacgattatttggtttgaagtgattacgacgctcgttctggcgctcggtctgttattggcgaacgtgctgaagccgggagtcggacttaacctctctcatcttgctaaaaaagacattcacgagctttccggctatacggaaaaagtagtcgatctgaaacaaatgcttcttgatattatccccgttaacatcattgacgttatggcgaaaaatgatcttctcgccgtcatttttttcgcgattttattcggtgttgccgcagccggcatcggcaaagcctccgcacctgtcatgagtttcttcgaatccacggcaaatattatgttcaagctgacgcagatggtgatggtcaccgctccgatcggcgttctcgccctgatggccgcctccgtcgggcaattcggaatcgcgcttctgctcccgatgctgaagctgatcggcactgtgtttctcgggctgttcctgatcctcttcgttctgtttccgatcgtggggcttatctttaaaatcaagtactttgaagtgctgaaaatgatttgggatctgtttttgatcgctttctccacgacaagcacagaaaccattctgcctcagctgatggatcggatggagaaatacggctgtccgaagcgggtcgtctcctttgtggttccgtcaggtttatcgcttaactgtgacggttcaagcctctatttatcggtgtcctgtattttcctggcgcaggcgtttcatgtggagatgccgctttctcagcagcttctgatgatgcttgtgctcgtcatgacaagcaaaggcattgccgccgtcccgtcaggctcactcgtcgtgcttctggcgacagcgaatgccgtcggtctccccgcggaaggcgtcgccatcattgccggtgtcgaccgcgtcatggacatggcgcgaaccggtgtcaacgtgcccggccatgcggtcgcctgcatcgtcgtatccaaatgggaaaaagccttcacatataaaggacccgtcacggcagatcagaccgcccggacagaaagtatgtaaacacaaaaaagaccacctcattggtggtcttttctattaatcaatcgccgcatgatcctctttttcaatcaaagcaaggcgttcattgatttcttcctgagtcatttcgtgctctttcacatacatgtttcgttcgttcgtacggcattcgtgactgcagctgcgcatgtatttgtattcattctcaggtgtgcagatcatttttttattacatgccggatttgcgcagttcacataacgctcgcacggctcgcccgtgaaataatcttttccgatgataacgtgctctacgcggttgaccggtacgctgattctttcgtcaaacacatagcactgtccgtcccacagctgcccttgcacttcaggatctttaccgtaagtgacgataccgccgtcaagctgggacacgtcttcaaatccctgcttcagcagccagccggaaaatttctcacagcgtacgccgcctgtgcagtacgtgaggatttttttgccttcaagcatgtctttgtgttcttcaatccagtccggcagctcacggaacgcctcaatatcaggtctgaccgctccgcggaaatgaccgaggtcatactcatagtcgtttctggcgtcgatcacgatcgtgtcaggatcctgcatttgctcataaaagtctttcggtttcaaatgcttgcccgtcgtgacattcggatcaacatcatcttcgagacgaagcgtcaccagctcttttttatggcgcacaaacattttgcggaatgcatggccgtcagcctcgtcaattttaatcggcatgtcggcaaaacgcggatcagctttcagcgcattcatgtattgttccgtctgttcaaccgttccggacaccgtgccgttaatgccttcctcagaaatcaaaatacggcctaacagaccgagctccttacaaaacttcaaatgctgagccgtgaactcttcaggctcatcaatctttacatatttataataaagtaaaactctatattgtttttccatgatttatacaccctgttcaattatattaatgatcacgcacactatactatatcatacaggaaaacgggcgaaagatgaacatttccgtccgtactctttcttccagtcacgcttcgccttttaaaacctgctgaaaataaaaccgatacgtattgcgcaaaaaggtctcaagcgaaaggccggccgcggtctgatacttgccgataataaacggaaaacggtcacggccttttgcccgcagaagatccgcgctgtcttcagccagttctgagatgagcgcctcaacgacaggccggcatgcatcccgcaccgcttcaagaatttgctgatcgcctgtatgccgatactgttcgatcagctttcccaaatccttttcttccataaagttcacttccttacaccatataaaaaagaggagcagcttttataaagcggacgcctcctcctgtgactccgcataaccgatgatctgaccgacctgtaattcacggccttcagtcaggttatccgaaggggtaaacatatctttctcgaatactaaaataacggtcgatccaaatgaaaaatagccaagctcttcccccgtctcaagccggtttccggtgtttgtctgaacgatcgagttaatattcatcgcacctaccggaatcatgagcatctgctgatcagcacgggtcagctcgtacacataacggtaattttttgagagcacatctttcccgtactttaaccccatcgtattaacgggataggagcgtttccccagctcggccagctttttatacgtgcagctgacgggagaatggaagcggtggtaatgtctcgggctcaggtaaagcacggcaaaacacccgccgttatacttgtgatcggcgcttttaaaccccgtcagttcggcgaacgaataatccttcccttttaccatgaaagtttgattgggattaatcatgcccaccgtctgaacgacgccgtccaccgggctgacgatggcgttcttctcttttgccacggggcggagattcaaattaatatcacgaatgaaaaatgacgccagtgaatcaaagtcagaagccgtgcgttccgtttcattccagttaatgcgatagtgtttggaaaacagcggaatcatcggcttgctcagtttcgattcacagaagtttttaatgagataagacgtcaatcgattattagtcagttcaatcaatgaacggtaaagaactttagcggcagtattaaacattgattactcctatgaattttcctatagtaataaaaataaaacaccataaaaacgctccgatggcggcgaagcataagtaggttttgaattccattctgccgattccggaaaagtagcaggtcacgtgtctgatgccggggatgaaataacctaaaataatggtgtacggcccgtacttcttcatccacctgtctactttctccatcctcttttccttcaggccgacccatttcccgaacttattaataaacggccggccggcttttctgccgatgaagtagctgataatcatcccaaggagcgctccgataaagctgatcagaatggagagcccgtaattcagcacgtttaaatgagcgaagtagcccacaagcgtcatcatgacttcatccggaataggcaatccgataataccgagtgtcagcataagaaaaatcgcgatatatccgtaatcggatattaattgctgaactaattccatcttctgctctccaggttttcaggcgcctgttttttaaagtgcggaaatttaatgttgctgaccattaaataaccgagcgcgatcgttcccgcccccagaagaaaagcgttattgataaagctcaaaatgacaagacacatacccgcaaacggaatcggcatcccgataaacgtcggcagcttgctttgttcaatattaaatctggaaagacggatcatcccgcagatgctgtaggaaagcgcgattaaaattccgatgaacggaagcgtatatagtgaaacactgtaagcgagcatggacggcgctacgccgaacgtcacgagatcagcaaaagagtcaagctcccttcccatctccgataccgcgttcagcttacgggcggccaaaccgtcaaagaaatcaagaaacatcccggtgaaaataaagatcaccgcagagtgtatattatgatacaaaagggaatgaatcgataagagcccgcaaataaaatttccaattgtaatcatactaggtatataattcacagtttacacaaacctccaattaaaaccatatcaaatcggactgcgtatgcataaagactccattttacggaaacataaaatgaaatcctttcaatgctatcattcaaattcttttattatacagcatttggtgttatttgaacaatctaatctggtgatttttgttttttcgccgttcatattaaggtaagcaatcatggtttcctctattccggattaccctgcttaaatattccatgctgcgatccggattgtccgttcttgatgaatgaaaagccgtatgatgtattgttatttccttctccgtgaaatgagaacattacatataacgattgcggacataaaaagtttcaagaattaaaaaaccggcacaaaacggcctcatacattatctcacaaccccgttttccagtatatagtctgtccaaacaaaaaaggcgccttaccattacggtaaaaacgccttttaagatcattttatgtaattgataaatgactgagtgcttcggccgctctttctctggcctcttcaacggtctcggctgcagaaagcgcaaccgccatacggcgtccgactttcgtgacgggtttaccgaatacgcggacctgagtgctttttaccgccaaagctttctccaaaccttcaaccgcataatcagcaagctctttgggcgccttcagcggacggcttgcccccggcgacagctgaatgatttccggaatcgggaatcccaagaccgcgcggacatgcagcgcaaactctgacaaattttgcgtcacaagcgttacgagccccgtatcatgcggacggggagacacctcgctgaaatatactttatcttcagtaaggaaaagctccaccccgaacaaaccgtatccgccgagctcatccgttatgcttttcgcaatgtgtttcgcctcttcaatctgctgttccgtcatatgatgaggctgccatgattcaatatagtcaccgtctttttgttcatgtccgatcggcgcgcaaaaggacgtaccgttcgccgcgcgcactgtcagaagagtgatttctgattcaaacggaatgaattcctcaacgatgacccggccgtttttcacccggccgccttccattgccatgtcccagcagcttttcagcccggaagccgagcggcacacgctttgcccttttccggaagagctcatcagcggctttaccacgcacggaaagccgattgtttccgccgcttctttaaattcttcgtatgtattcgcgaattcatagccggcagtcggaagatgaagcgtctctgctgcaagccgtctgatgccttcacggtccatcgtcagctttgccgcacgcgcattcggaatgacgtgaaacccttcttcctcgagcttcagcagctcatccgtcgcaatggcttccacttccggcacgattaagtccggtttttctttctcaatgacttctctgacctgcgctttatcaagcatatcaatcacatagcttttgtgtgcggcctgcatggcgggagcatgctcatagctgtcaacggctacagtgacaaccccgagccgctgcgcttcaatgacgacttctttccccagctcgcctgatcctaataacaacatcttcttcgcctgatacatgtcctttggcccctccctttctataccccactcattataacggaaatattcaaaaaataaagacaagacagattacaagctctatcctgtcttttgtgctgattcgagcgattcaatcgccgctgacacgtccttcccgcaatattgccccattaagcataacgattcttccgcccggcaggcgtgagaagcgatgcggcgctttgcttcctcatggttgtcaaggatgccgagagcacagagactgacggggaaaccgagccggcggtaaaacggaagcagctcttcaatctcatgtctccgattctcaagcgcgagctgcaccaatatgccgtaagcaaccttctggccgtgcagcacctgatgtgtctcctgaagaaaactgaggccgttgtggaccgcatgcgcccctgccatcctgcacaaacggccgccatacccgccgaccgttctcgcaagcataatgatcgtttccgccgtatggatgaacggcacggacagctcgcctttctccatgcttacgacggcggcttcactgtaacgcaataacagattacgcatatattccgcctgtctcagccccgcctgcgccatcagaggcggcgcttcctccgtatttctgatgaccgcctcggcctcataccatttcgccagcgtatcaccgatcccgcttttcatatattcaatgggagaggaaagcaaaaacagcggatcaacaagcgtcaaatagcttgaacgcttgtgataatcaactctgataaaattgccgctctcatcatatatgacactcaacggcgtacttgccgcacacgtccccgcaatggaaggaagcatcacagcctcaatatcaagccggtctgccgccgcttttgccaaatccaaaatcgtgccgcctccgataccgatgatcacatccgcgtcttccgcctgcccgcagaccttacgcaccgcctcaggtgaacagtatcctttgtgctgaatcacatcccaggaagaaccgccgccgtaatcggagaacgcctgataggatttgattccggtcacaataacgggttttctgaatgtctccagcagccccggaagttcttttgcgattccttccttgcatatgtactgattcgggccgcttcggacgatatcttcaggcttcattcgaatctctcctttggctggaatttatacatattttctcacttgtcagaaaatacatcaaccggaggtgcgtcagcgcttcgcttcctccgcctccaaaaacagctcatcaagccgctccaaagcttctgccttttcaaaactgctgaaccacagatcatcataagaatcaaggatgcggtaatgatgggaaatcaaatgctgctgcaagcggaactcgccttttttctcgatggctttccaccacaccttgccgcccatcgtcttccccttcggcctgtcaattgtgcggtgagcaaccgtttcaatgacctccagcggatcatctcctaatacggattgcagtgtttcacttgatctgaaaagcgcgcaaaccgccacaacgtgcggccattccgcaagcgcccgccctttctcaatctgcaccagcgactttttagaaaggccgatcacatccgccattttctcctgtgtgtagcctctctccgaccggattttcttcagctggactgagacaagctcagtcatataatcttgatccatctcaacctccatttttatcaatatagccattttacaccgcggcacgccttttttatatcagaacattttcaaacaaatcaaaaggacccgggatcggcttttcattgaaacgatgtacctttccgcataatccagaatgatgcggtgaatacaaacgtacgcccgaagagacagatgcggtctccctggcggttgagctccggagaaaataaaaagctgccgcagctgcggcagctaaaacattataagctgaaaatcaaaattatgaagcgaatacaatccaactcgcactataattgacacgttttttcgaaccttgattgaccattttaaatctgtatgaatctcctttttttaacaaaggtgtttcaaaataagtcgttccatttttctttgcattggcggttttgattgttttccaggcacctttgccgttgacttgcttttgaacgtatattttatacgtgcccttccctttactgttggatttaaaagtcacggctctcaagctgtacttttttgtcgtcttagtgaatttaggatgatatgtattgatcacatagttagtgaaatacccgcttttataagtatgaagccagtctttagcctctgctttttgcggagaagaaaaacccataaaaccaattccgctgattaaaagagtaaaaataatgatgagcgacttaaaaatctttttgcttttcatcgagaaaatccttccttcctgtaactatttaccctatttatgttaatgacaatatagctaatcataaatccgtccaactaaccattttgactgcagggagagatgaaaacagccctgaaaatgactatatgactactacttatgattcttgttatttttgattaagtgataaagttactttaaagcgctatccattttgctgtttttgtatcaattgtcatagagagatcttttcctatcaatgcctctctatcggcgtttgtatgatggggctgtcctcggacaaactcctgcacccatgacaaactgtcatacgtttgccacctatgaatgaacgcacactacacgtaatggagggattgcaatggacgaaatggtcctggaaacacaacaatggctgaatgagacgtacaaaggcagacacgggtacaacaaggtgccggaaaacggaaaaacaggctgggataccatttacggtctgacacgggcgcttcaaattgagcttggtatttcagaaccagccgataacttcggaccgacgacacaaagattgtttaaaccgttgaaaaagcaggctcccgattctaagccgacaaacatgaattacattctgcagggggcgctgtggtgtaaagggtttaacccgggcggattttctggcgttttctatgaaaataccgaaagcgctgtaaaagagtttcaaaaagcggccggacttactaagcaagacggcattgtcacggcactcattatgaaggctttgctggatatgagcgcttttcggttagtagcgggaggcgacaaaagaatccgccaaatccagcagaacctgaaccgggattacaatgactacatcggcttgatgccttgtgacggcttatatgcccgcgatacaaacaaggccctcatctatgctctgcaaaaagaagaaggcatgagcacaagcgtcgccaatggatttttcgggaacggaacgaccagcttatgtcctaccttgactcccggcgattcacggacaggctttgttttgattgttcaatacgcgctttactgtaatgggaaatcatttgaccccggtgaattcgacggaaaatacggcgtcggagttgtatcggcagtgaaagctttccaagaatttatgtgcctgccgcagacaggttatgcggacatgccgacgattaaagctttattatcaagctcaggcgacacaacgcgggctgcttcagcttgtgacaccgctgccattttgacggcagatacggctaaaactttgcgtgagaatggctataagatcgtgggaagatatctgaccgggaatgtgcggactagcagcggactgacatcgaaagcgttaacgtcaaaagaactttccgcgattttcaatgccggcttaagcgtgtttccgatttatcaggacggcggctatgaatcttcttattttgtaaaagaccaaggaacgagagatgcgtacagcgctgcatcagccgcccgaagattaggttttccgtcaggaacgaccatttactttgccgtcgattttgatgcgtatgattatgaagtcacggataaaatcatcccttacttccaagaaatcaagtcagcttttatgaaaatgcaggcgttctcaactgcgccgaaatatgaaatcggggtatacgggccgagaaacatttgtatccggacgtcagaagcaggtctgaccaaatatagctttacggctaacatgtcgaccggattcagcggcaacctcggatacccgatgccgaaaaactgggcttttgatcaattttatgaaggcacgatcggaagcggagcgggaaaagtcgccattgacaaagacggatactccggaaaagactcgggtgcaagcagcgtccatccgccttctgatcccgtgtatgatgcaagactgcgcacactgacggacattttaacaaccattcctgctttagaaaatatatcgaatcttgcgaatgccatgtttgaattcgacaagacagaaaccatttatgcatcacctgaaatggatattcttttatctacttcacttttggcaacagtgccaagcgaaggttctcccaacacagttaccattacaaatggcaaaccgggagcttatattaccggtctgatgggagattcacaagtctcttttacagcatcacaaattgattcgtatcaaaacctgcttaacagtctgagcttgtcagtgcgcaacggttatttagaagtgtatgtcaatccggctgcgggatcgctgaatattcaatttaaaatttatacacctgatattccggtcggtgacagtgctactactggactaacaactaccattacatttaaaataaaacaaaagagcttcagattgccggattccgaagaggtgtactctccggattgggattctgtcgtgaataccatggctattgcaggcgcaggaattattgttattgtagggatcggtgctttagtcgttttagcacctgaattaggaggagctgcagccttgttcagcacagttttatcactatttctataattgaacaggcagctccttgctccaggaatgctcaatgagtattcttggagttattttttaaggaggattcgtatgaagattgatatgcagacatacaaggacaccgttcaaaaaatagaaaatgatttgattccgcgaagtcaaaatgacaaagaactgcttacatatttaatgaaacaagattcgctcacactgaatcaaatgaaaatgtgtttcactgaaccgctcctcaccttccaacatactgtcaaaatcgtatgtacagtcacattcatcacgttatatatcttttttttcagcactcattttaatgatttgattgaaatggctctgcagatggtttttggcctggccggccttgtttggatttttgctgtatttccgttttcaaggaaaatccaagtgtctgaccgtttcagacaaaaatctgaaaacacccgtatcaccggaatgatagactttgtcctcgaacaacgatacaaagacatgatcagttaaaaacccctctgcttaaggggtttttttatgatgcaatcccttcaccccccttatcaaaaaaggctcttcccctttggaaataaccggaacacccaatttcgttttcaatataatgaggtagtggatctgcaaagaaagaagggcgacatgatgggtatcattaatggcaaaatgttcattgaccgattaaatcagctaggaaatgagatttggcttgatggtgaaaagatcgagggacagatttctgaacatcccgcatttaagggccttctggaaacgaagcgctctctttatgatttgcaaacgaaaccggacatgaaagatcaaatgacttacagtcttcccggtaaaaaagaacgggccgggctttcatacctgcagccgaaaacgaaagaagacgtaaaaagaagaagaaacatgttcgaacattgggccagacacacgcacggaatgatgggacgaagcccggattatatgaataccgtgctgatgagcttcgcctcctctgccgcgcttttgaaagaccgtgatcaatgttttccggaacatgttcaagcgctgtacgaacgcgctgccgcacaggatctttcttttacgcacacgtttatcacccctcaggtgaatcgttcacaaatgggtgtaaacgtatcgccgacacctatctcggcaaaagtcgtcgataaaaatgaaaaaggccttatcatacacggcgcgcggattttagccacacaaggcggcctgacggatgaagtgctcgtggtttctctgcctaagatgtattttgaatcggatgaagcgttcgctttttcaatcccttccaatacaaaaggagtaaaattcatctgcagggaatctttcgtactcggaaaatcatcgtttgattatccgctcagctcaagatatgaagaaatggattctatcgttgtatttgatcacgttttggtcccttgggaacgcgtatttttttataataattacgaggcggcttttgattttaatatgaaaagctcttttaacgccttcgcatttcatcaagttatcacgagacaaattgtaaagacggagtttctcctgggcctcgcccaaacgcttgtcgatgcgatagatgtgggggaatatcagcatattcaggccaagatggctgagatcatcaccggtctggaaacgatgaaagcccttttggaaaagtcggagaatgatgcggaaacagacgaatggggttatatgcgtccgagtgtcactccgcttcgcgtggtcagcgcgattttccctgacatctacccgcgcttcacggaaatcatccagctgatcggggcaagcggaatggtgactttgccgactgaaaaagcgttccgttccgacatcagaggagaccttgaccaatatttacaggcggccgaattgaacgctgaggaccgggtaaaagtgttccgcctcgcatgggatttgaccatgagcccctttggaacaagacagacacaatatgagcggtacttcttcggtgaccccgtccgcttagccagccatctgtacagaagctatccgaaagaagaacagaccgcggtcatcaaggaattcctgcacattcataaataaaacaaagcagagaacgcatctctgcttttgatagctggatcggctgccgccgatcctattttttgttttggctgatcaccaccatcgtaatatgcgataacgcgaaagagacgagcgtgtacacgacggcccacccgataaacgagaaattcaatatggtaaaggtgcatataaggcaaacggctaaagcggcagccggcataatgaacgcgtttttaaacaggtacgttccggcgactgacaggatgatgatacaaagcggcagaacaccgaacgcaaaatccaattcatcaatcaacagatgcactcccttcgcttttcttagttcggcctaacacatcttatgcctgagtacaaaatcgagtacatcaaatctttcgcgctccggctgatattccctccggttatttattcaaaaaaatgaaaactttccttaaagcgtttacattcacgccagactgtgataatttaagaaagcgctatcatatacaagttaatgatttttggatggagatgaggagaaccaggaaaccgcgccctttcataagggtgatttctggttctttttgtcattttcaaggaaaggagtcatacatacatcatgatagacgttcagcaaaggggaggatatgatgtttcaattgttcaagccggctccgcatattgagagattggatgattcaaagacggatgcggcctataaacggctcaggctgcaggtatttttggggattttcatcgggtatgccgggtattatttacttcgcaaaaactttgccttcgctattccttattttcaggaacaagggttttcaaaaggggaacttggcttggtgcttgcggccgtatcaatcgcttacggcttcagcaaatttattatggggatggtgtctgaccgctgcaacccgaggtatttccttgcgacaggtctgtttttgtcaggtgtcgtcaacattttatttgtttccatgccatgggtcacgtcaagcgtgacgattatgtttatttttatgtttattaacggatggtttcaagggatgggctggccgccttgcggacggacgatggctcattggttttccatcagtgaacgcggaacgaaaatgtcgatatggaatgtcgcccataacataggcggaggtattctcgccccgctcgtgactctcggcatcgccatgtttgttacttggaaaagcgtatttttctttccggcgattatcgccatcgtcatttcatttgtgattgttcttctcgttcgggacacgccgcaatcctgcgggcttccgccgattgaagaataccggaatgactatccgaaacatgcgttcaaagaccaggaaaaagagatgacgaccaaagaaattcttttcaaatacgtgctgaataataaatttctgtggtatatcgcatttgccaatgtctttgtttatttcgtgcggtacggtgtcgttgactgggcgccgacttatttgacggaagcgaaagggttctctcctgaagattccagatggtcttatttcctttatgaatatgcgggaattccgggaacgattttgtgcggctggatcagcgaccgatttttcaaaagccgccgcgcaccggccggcgtgctgttcatggccggcgtatttatcgctgtattggtctactggcttaaccctgccggtcatccgctcatcgataatatcgcgctgatcagcatcggattcttaatctatgggcctgtcatgctgatcggacttcaggccattgaccttgcgcctaaaaaagcggcgggaacggcagccggcttaaccgggtttttcggctacatcggaggctctgctttcgccaacgccatcatgggttatgtcgtagaccgctttgactggaacggcggctttatcatgcttatctcctcatgcgtgctgtccatcgtcttcttggctatgacgtggaatacaggcaagcgggcggagcatgtgtaagaaaacaacataaaagattaatatttttgcagtacagcatttacaacgattttctacactagagacagatattgatttttaagggggaagaaaacatgcggaaacataagttgtttgctttggtattgctttcattcggtttattgtcattcatcgtcacgcctgtatcggcggcgggaaaaggaaacctcttgtctcctgacagaattttaaccattgcccatcgcggtgcttcggggtatgtcccggagcacacgatcctttcttatgaaactgcgcaaaaaatgaaggctgactatattgagctggatttacaaatgacaaaagacggcaagctgatcgtcatgcatgatgaaaaactggaccgcaccacaaacggacaaggctgggtgaaggatcatacattagcagagattcaaaagctcgacgccggttcttggttcaataaggcctatccggaaaaagcaaaaccgcaatacgccggacttcgcgttcccacacttgatgacgtgttaaaacggttcggcagacatgcaaactattatattgaaacaaaggcgcccgaaacatatccgggtatggaagaaaaactgatcgcctcactgaaaaaatacaaattggcaggtaagcatgcgaaacttggacaagttatcattcagtctttcagcagggagagccttctgaaaatcaaacagctcgatccgaaacttcccgccgtccaattgcttgaagcggaacagatgacctcaatgactgacgcagatttaacagacatcaaaacatatgccgtcggaatcggaccggattacaaagcgctgaacgctcaaaatgtccgaaacattcgcagccacggcctactgcttcacccttacaccgtgaacagcgagacggacatgcgccgtctgctgaattggggcgtaaccggtgtgttcaccaactatgcggatatatttcaaaaggttaaaaaagaatataaatcataaagccagcatgggttcggagatgatgccgaacccatgtttttttgcctgatcaaaaaaccttgcgggaacgttaccgcaaggtttttatcaatcattattcttttccggcagcggcttccgcctgcccgccttttaattgatcgttgattgctttggcgtctttcaaatactcagtcttgaatccgctcttcagcgcccacgcatagaaggcaagggcaacgattgcgatcagccccatatcccatccgtacggaatgatgttcagaccgccgaatttttcacttccgagccatgaaatgaccatcatgctgagcagatagacaaccatccaaacgccgcctttaaagtttctgcggaatcctttccacttcgctttcgcttggtagtagaaataaatcggaaggccgatcaaaatgataaacagcacctgccctgttaacggccagcgcgcccaatacagcacgagagacgcgaacacgaagccgagcggtgcaaccacgctgagtcctttcagacggagaggcctgtacaaatccgccgccgtcctccgcagcgtcattaccgtcacgggacccgtgatataagaaatcagcgtcgctacggaaatgatttcagcaagcacgccccatcctctgaataaaaacagaaagataaacgatacgatcaggttgaaaatcatcgcttggcgcggcacgccgtacagcggatgaagctttccgaaaatgctcggcatatatttatttttttccatgccgtaaatcatgcgtgacgtcgtagcggtatatgtgatacccgttcccgacggagatacgaacgcatccgcataaagaataatgacaagccagttgatattcaatgcgatcgccaaatcggcaaatggagagttaaagttcaggtgactccagccgtgaacgatcatggaaggttcaaccgcaccgataaatgcgatttgcaataggacgtaaatgacggttgcgaccagcagcgaaccgacaaccgcaatcggaatcgatttgccgggattttttgcttctccggccatgttaatcgggctttgaaacccgttaaacgcaaatacgatacctgatgtggccaccgccgtcagcacgctcgcccagccgttcggcgcaatgcttgaaccggatgtgaagtttccgccgtgaaaaccggtaaacagcagcgctccgattgtcagccccggaataataattttaaagatggtaatcaatgaattcgcttttgaaaacaagttaactgtccaataattcagtaaaaagtaaataatcagcaatacggatgcgaagccgagccctctcccgtaagtgtgccgttgtgaacgagattgcttgtccactttgcccagtcccacggccatgagctcatatattgaacagacgcaaccgcctccaccggaataacggaaacaatcgcaatccagtttgcccatcctgcgataaatccaataaatgatccatgagaatattgagtatattttaccattcccccggcttccgggaacattgaacccagttcactgtaagaaagtgcgataaacaaaattacgatcataccgataatccaggaaataattgcggcaggtcccgcaatctgagccgcccgccacgccccgaataaccaaccggagccaatcatcgacccaagtccgaccatcatgagtgcaaacgttcccattctgcgatgtaattgattcataaagttaacacctttcaattaaaatatgactccagcgctatcatatatttataatattattctgaaaatagttttgtcaatctttatcgcattaaagcggcaagccaaaattaaccttccgatgtttaaacagccgttaagcgggaataactactgcaagccataaatagaaaggagtttttatcgtgaaacaaaaactgctcatttcaggacttgccgtgtcgactgtcggagtgacttcctacctgctcaaagataaatcaaaccgccaaaaggtgatgaactttatccgcaatatgaaaacatcgctctccgggaagcaggatattgaatcattccccgtcaacaaagcaggcaacccgcatcccgaagatattgaagataacaaaatggtatccgaaggctccatgtacccggttcaatattatgatgacaagaagaaataatctgtgcccgggctgcccggccgtatcaaacggcggcagctttttttatgcagacggcgttttatagatccgccaatattggcgcgatcctttctcccgcacggtaatgcccagtttggatatttccgctttcagctctttcgcatcagccttttcctcctctttcagcgccttttctctcgcttttaaaagagcatttgccccgggctccaaatccggcgtgtccggcacccaccgtttgtattcttctttaaaaggatcttccgtccccagccagacatacccatgcgcgcgaaacgcatcagccgctttttcaaccgccggctcaagcttctcccgaaaaagctcctgtccttcagtgcctaataaaacaagatacttcccatccgtaaacacaccggaaatgctgtctttcgaaaacacgctttcttcattatatatggttaaggacaccccgctgtccgtcacgactgccacaagactttctttaaaagctgcccgcgtcagccacactcccccaattaagccgataacggcggttgcagccgcagccttccatccgtgaaaggaagcgattatttccagcggcccgtgaaaaggcagccaatccaatgttacggcccacttcgtaatgaccggcagaaaccatccgatgaccagccccaataatggcggcaccagataaaccaaagctttttcaaccgatgacaactcaagaaccgtctgtttttttatttcgttcatgtttctcctccgtctgtgtttttcacaactatccattatacaaagggttggatgattctgtaaactggttccgaaacaataaaaagcctcccggccgccgggaggctctttaaaatagaagctcatatacttcattcaattccatcgtgcgcttctcatcctgctcgttctcagcatatttgatttccttttcaagcacctgattcagcgcatccatttccagatcatttagatctttcacgaactcgccctcatttgcataatgcttcacctgaagctttttataaaccccccggcacacatcatgctccaagtggttcgaaagcgactcgcgcaaatatccgagtgtcctgtccatcatgtaagccctcccttttctttaggaatagcttcccggaaagagagaaaaactatacatgaaagcaccgggcggctgttttaactctgtacctgaatggagaaaaatccgctgcttaacggcgtgtacggcccgttcagccccgttgcggagaaagagaacgttcctgaactgacataagaaagaggaacgctgtaatatttaatatagcctgtaacgatattgccgtttttcgtatattcatcttccagcgcttttgacgtaagatttgtaatattcgttccgttgttaaacgcctggatcgtattattgttcggatacccttggaaatatacggctaaataacccgttgtccccttcatcggttttgatgcgctgatttggttcggaccgatattttcccattggtaattctgaccgtcagacgtcacaccgataatacggatttgtgttaaagcaggagccggcgccgcagacgctgacggaacccacaacccgctcacaagcaacaaagcagcggcggccgcggcaaatagcataacgagtctctttttcatgtttcttcctccttgtggttcaaatttataattatgttaaatattataagtttcattttatcagagaaatcaatagatagacagaatcaatcagtcaaattggtgaactttttatataaaaaagctatctcctaaaggagatagcttatataacattatttctttccacactccaaaattgtgtatttactcggagtctgaattacatttaatagtgttaatccggctttttcaatcaattgttcaaactcggttatctttctgactctgccgcctgcagagcatactaaaaataataaatcacgaaaagcttcttcaggggacagcctgtctgcttcaggcacattttcaactataatcagcttggaatgatcagacatggcaccggctatattttcaagaatagcaaccacatgctcatcatcccaatcgtttaacactttgcttatcacatacaagtctccgccggaaggaatttcctcaaacatactcccttccgtaaactgacagcgttcgctcatctctgaagatgctaaatgcttttttgcactttgtatcgtttttggaagatcaaacaatatcccctttgatttaggagccacacctaaaatgcctgttattaactggcccattcctcccgcgacgtctacgataacatcaaacttttcaaatgagtaagctttcaatatggatggcagactcatttttgaataaatctccatcgccttatccattgtttttaagtaatcttgatcaagactattattctcataccatttatcaccataaatggcttcaaaagcggatttgccggttttgatactataatccattttaaacatagactgcactactgtttcatgcagcagatattctaccaaaggctcaatggattttgctttcccaggcatcaaagtggcaccatactctgttacatcataatagccattttgagcttgggcgaccaaaccgacggattccagcgctcttaagagcctgaataaggcagaggggttcaattcaagggcttcagctatcgcttccgctgaagctggtccattttgaaaggcggaaaatacatccaattctaccgctgttttaactgccagggaaaaccccagccctgaaaccatttgcatgactgcggcctgaggatatttcttcggtacttgtttatcttgctgaactgaattggtcatttacgttaacctccgattaattaaatggtttctgctgcttttttgatataacgcatatactgattgagcagattttctacagtactcttatagtactgattttgattatattcaattccaatgctcaattttttctctcttaccaacacaataaacttaaacttgtaattccaaatttcatcttcacttatatcattcccggttgaaagcggagataccgtaaagctttctgtgtgcagttcattatcaaattcgcccatataattaaatgaaatgtctggttttgatttctcttttatatcttgttttaaatatcttaaaataccatatcctatcccttgatcaggaatattggctaaggtcgagttaacattatctaaactcgaaccgatatgatcagaatcggagacctccaaagccaccggatagattgcagaaaatctgcctactgttctgtagatattaagcttctcactctgatgagtgcggccatggttgcctaagtgcacgagagatgtattactgcctgtttgatgttttactgtcaaacctaaagctgtgagcaaaacagtctcaatagtgaaatgatcttgtccttgaatcgcattcattatattttcagtttcccgaacattaaactgcctgtacacttgtctgttatctttgactttggcaatttgcccctgaatatcaaccggaatagacggagcataaacattttcgattttcgtccaatactctttctcaaacaacagccgttcactttcagcatatttatagagataatcagaccattttaaatacgaatcggttttatttggtaatacaatgtcttcgttacttttaacttgctgatatgctgtattaaaatcttcaagcagtattctccaagacatatgatcaatgatcatttggtgaatgacgattaacagatgttccccatctgcttccttaatgagtgccaatttaacaagcgggccgtgagtcagatccatactggcttgtatttgatttattttcatttttaaaactgattgcggcatgtttattgcattgatcagatgaaagtcaaacaagtcgccgtccgtcaggcctctgattacctgtaccattctatcgcctttacgtttgaatactgttctcagactgtcatgatgctgaataatccgggtgaaaatgtcttttacaatatcttcgccaaacccggcttccctgtataacataaaagaaagattccgatggtgcagagtatcattatggctttcagccagccagcattgaattggcacaagacgggcttctcccgttatcacactgttatcagatgccgctgttatataactgactttattcgaaactccttcgattgtctggtaatgaaagatgtctttcacttccagcctaagattgaatttttccattctgaccgctgcttgtatggctttaattgaatctccgcctaaaacgaaaaagttatcttttatactgattttagaaacttcaagaatgtcggaccaaacctcactgacgattcgttcaatctcgtttctcggagcaataaagtgatgcagctcggcattattttcagctggaagcggcaaacgttttacatcagtcttcccattgttcgtcaacggaattttatctatgccaataatgactgtcgggatcatatattccggcagatattccaataagtattcttttagctgagaaggcggctgcgtatctttacatactgtataggcatatatctgatcattgtgagcaatcgcaaccgcttcttgaacattgcggtgagacagcagtctgtttataatctcatccagttcaattctaaatcctctgatttttacttgtcggtcgattcttccggcaaattctatattcccatcctcattccacttgcctaaatctccggttttatacattttctcaccagaatgaacaagatccgggataaatttagccttggttagttcttcacgattgcaatagcctcgtccaactccttcccctccgatgtataactctccgataactcccggcggcacaggcttctgctgtttatctagtatgtagatagaacagttttttatcggtgtgccgatagggattctctttatattggaaatattatcctggtttatcgtataagctgcagcatcaacacagcattccgtcggtccatatacatttgttatataaggacggtcattctttttaaatactttatagaaacgctttacttcttcaggtttaagcacttcgccgcctataataaaatgttttacacctatacggccacactgcggagactcagagagcaggctgagataggctggtgttccatcagaaatagttattttattttggatatagaattcagcaagtttcgtgatatcatgcctggcttcttcagagacgatgtaaagagagtgtcctaaaagcagtgcagaaaaaatctgtttgacagaagcgtcaaaagaaaagggtgccaacaacgctacattctgctgcccgccatgtttgcagtagatacgttcatgcagggcttctgttaaattcgctatacttttatgttcgatcatcacaccttttgggtgtcccgttgatccagaagtgtagatgatataggcaaggctatgcccttccgttcctcctttaacattcctcccgtcgtctggaactgtttccaattcattcagacaaacactttctactccgtacctttgaccatgattgttgcgatccgtcagtaacaaacgggccccgctgtctttgagcatatactcaactctttcttgcggatatgatggatcaattggcagataagctgctcctgcttttaaaattcccattattccgatgataaaatcagtggttcggtctgcagctatgcctactgcttcattctttttgacacctttttgaatgagtgctcttccaagccggtttgcatttttgttcagctcactataagttaagcttccgtcttgtgcagacacagctatttgattcggcgttgcttccgcctgcttctcaaaaagctcacagatagatgcatctgtgcctctgcttctcagtgatcttccactgtaactcaatatttcgcgtcgttcattttcttctaaaatgttaatctccccgattagtccatcttgactttcaacaatatgattgaggatcattaagaatcgctgtgagaatttttctacagttgtgcgcttaaacaagtttgatgaataagtgaactcaaacttgatatcctcttttgaaggaaatgcttgaagcagaagatcaaatttggctgttttgttttcataaagatacggcttatatttcagcccatttacttcaattgccggattatccatcagctgaaggacaaacataacgttgaaaagagcattctggtttatatccctctcaaggttcaaatggtctacaagctcttcaaaaggataatcttgattttcataagctagaagcgcattatccctaacggcttcaagcagttctttgaatgttttgtcggcagatggtttatttctcagtgccagcgtatttacaaacattcctatcatgttttctaattctttatgctttcttccggctacaggtgtgccgataataatatcttcttgaccagtaagtttatggagaagcacattaaatgaagccattaaagtcatgaaaagggtgactttttgttttgcgtttaattctgttaacttggcagtcagctctcttcctgcataaaaatagattcgttcaccttgatcatctcgttcggcttctcttgaaaaatctgcgggcagattgagaacgggaatttctcctttaaactcatttaaccaaaaatctttttgttttttcatttcttcagtatgaaataattcattttgccatatcgcaaaatccttaaattgaatgttcaatgacggcagttcgttgccttcgtataaatttatcaattccctttggaagatcgggatagacgccccatccgctataatatgctgtaaatctatcattaaaagatgtttttgatgactaatctcggctaatcctgcacgcagtaaaggagccttttctacatcaaacgggcggacaaaattagacataaggctctctaattcttcttcggaggtcttgattctatccattttaaatcggacgtctttttctatgatttgcacaagctgcccgtcccttaaacctatggacgttcttaaaacctcatgcctgattattaattttttaaacgcatcttctaaacgtttatcgtccaactctccttcaatcattaaaaagaacgggatattataagaagtgctgtttttatttaattgatctagaataaaaattcttttctgtgcagatgaggcctcataccactctaaatcgcctgctttgggaatcacattcacatcatttgtcttcctcagagaatattcatccaaataagctgagaagagttttatattcgaatgctttagcaagtctgaaactgaaagctccgttccttgctgtttattgataaagttgatgatttctattgctatgattgaatctccgcccatttcataaaaatcggatgtaacatcgatcggattgattccaagggcatttccccaaatttgtcctgccattagctctgtttctgaataacagccgtcttccctgccactcagtcttattatttgaggcttgttgactgaagggttatctggtgcattgcttatcggtaatttttcaggcagtttcacccaatgtctctcccgcaaaaatgcgtaacccggcaagctgatttttcttcttttttctccttcatataacatttcccaatcgatctctgcacctttttcatagagcttgcttatatcaatcagaagactctcatctgttctcccgcctgcattataagccttaagtttttttccagcagcggtacttagatctctatcggtcttataagaaaatgcagcttcttcttgctgaaccggcgcttcgagcagactttcaagtttttccttcagatcttcgatgtcttttacgagaaaacacactctattctccagatgttttcttcccgtattcgctgtataacaaagatcagagagattcaaattgttttcttccgagataaaatgaagatactttgatgctatatcattcaggacggacttattttttgcagacagagtgaatacctcttttacctgtctctgttcagtctcacctattatttcaggtgcttcttccaatacaatatgacagttggttccgctgaagccaaacgaacttacaccggctcttcttggcgtctctcctttttcccaatttcttatcatgtcattcacataaacaggtgaattcgaaaaattaattaaaggattcggttcattaaagttgatacttggggggatgaccttctcttttaaagccatgcatgctttaatgagagacgccatgcctgatgccccgactgtatggccgatattgggtttgactgaacctataccgcaaaactgctttttatcggtatatttcttaaacgcattcgttatccctttgatctcaatggggtctcccaaaatcgtgcctgttccatgtgtttcaatataagaaatagtttccggactaatattcgcattcttccaggcacgtgaaatcaatttctcttgtgattcagcattaggagcagtgattccgttagaagccccgtcattattcgtagcgctccctttaatgacagcatatatgtggtctctgtcttctatagccctatgtaaaggttttaatacaatagcagaaatcccctcaccccatgcggtcccctttgcatttttatcaaaaatgctgattttagcgttttccgcttctatttcgctcatcgtacctatattttcaggtctcagaaataaattaacgcctcccgcaatagccatgctgcattcttcatttttaagtgcctcacaagcaagatgaaccgaaacgagtccggaagagcaggctgtatcaacaaccaagcttggccctttcagattaaaaatgtaggaggtcctgcttgccaatatgccgggataagtacctgtcattgcaatcatatccgcatcctttactagggaagcataggaaaacttcaagtcaccgctatgatcatgtccaacgaaaatacctgtattcgaaccttgtaacttgttccccgcataaccggagtcctcaatagcgtgataaactgtctccaaaaacaatctttgtttcggatccataagcatggcttctcttggcgaaattctgaaaaatgatgaatcaaacttatcaatttcatctaagaatcccgctctaaaataagaattctcattcgcactgggcagcaatggatcaatatctttccgccgcttctccggtaagtcccggatgcatgaggcacggttcataatgttttgccagtattcttttgcattattggcttttgagaaacggcaggatatgccgataatggcaatatcaaattgatttttcttggacttatcagataatccttttaaaatgcgcaaagccatttccctgtccattttttgctcttttacttgctccaatacatattgttttataatcgaaatatcatccacgattaatcacccctatcgattttgattctatataaaatatgagaagcatcatggatatatagaatagctgcttcaattgaagcagcttattgaattagttaatttttgtctcaaaaacctttccatcttctttacataacacctgcaccagatttctggcctgtaagacaacactcggaagacctcctcccacttgactccaatgcccaaccatataaaagtctttaagtccgggaagtgaacgtttcagttttttctcgtgcatgatgccttccatctgtttttcccagccctgccagcttccatttctattatttgtgtatcttctgatcgtatatggggtggatacatcagtcacgtcaatatttgatttaatttcaccaaaccatttgtctaattcatcaatcattacattcgcaattgcttttttctcttcttcatatttttcgcggttgtttttttgcaaagtctcccagtattcagcagaagttttcgcatacacgataatactcgttttgccatcaggcgcgaatgaaggattttcgttatatattttcacaaatatgtttttaacgttgtcacagccataggcgttaagaggctgttctaattccagactcaaataatgaggatatttttcaaacgtttttgatacgcccaatccgacataaatttgcggtgcacttgttttaaggttgtcataacaaaatgtcagttcatcatctgtatattttccatccagcatttcaaaaatagttttatagccatccgctgctgaaatgacgatatctccataatgacactgtccgtttttcagctctattccgatcgctttatcattttctactaaaaccttagaaacaggtgatttatattgaatctcaccgcctaattcaacatatctggcttcaataatttttgcgaattgcagagaaccttctacaggatgtcctgaagatttgctattagcccagcctaaagtagccataaagtaagatataggggtatctacattaaaccaaaacagacgatttacattttctcttacaaaactgcttttaaagcgctgggcgaattctttgatcgtcacttttccccattgccccattactttcatgtaagggccagcctttgctttgaaggcctcaaagtctgctaaatcgaacagttcgggcgctttatccaaatccagctctacatcagaaacaactcgaatgccatcagttaaaagcttaattgtttccgcatcttcaggtgcaactcttaaaaactcctgttctaatttatctacatcagcatacagcgtaaatgtatcaccatttctaaagttaacaaccgcaaattcttcatcattaatgaattccatattttgtattacattcagttctttccaaaatttatggaaggtattgttaggtcctgaaccgaccagccagctgatacaaccgtcaaaaaagtacccttttctcttccagccggtacataaaccacccggcagcaagcccatttcaaaaattttcgtgctgtatccgttcatttgcaagtaacagcccgcggccattcctgcaataccgcctccgattatgattgcagtcttgttttcttctgtattcttcattaattttccccttttccgaaactagttttctagaattttcaatccttcttgtatattgattttgccgttctccaggtcgtcaaatagattgttgagttcttgctcaagccgattttcagcagtatcttcttccgtttcttgctgatgatctttattcagctgcttgtcaatatactctgatagctccactacagaggaatatgtaaatatatcggatatatccacaatgtcaggatattgttgatttatcagttttaacagttgggttgccataatagaatcgccgcccatggcactaaagctttcatataaatccagctcttgcatatccaaaaccatagagtacatttgcgcaatacttttttcggtatcagagtaaagttctccctttcctttcagcactatatcttcagtatctgttcttcgacgtttttctgcttcgttttttgtcctgtttttatctattaatttgtttttgatttgctcagataattcaaaagacaattcatccttcgcaaaagcgaggagcttcatatttaatgtacctggaatgatattagtaagcttattcgatgctatttcttctaaaacggaaatagccctttctaccgtcaataatctgaaaatagagctctcatcagtaattccataatcgacagctatgccgacctcatcccaagccggccagttaattgacagcgtgtttttcccctgtttgttttgcatataagcaaaggaatctaaataagcatttgcagctgtataatctccctgtccggcacctccgaaaatagaattaattgaggagaacaaaatcgtgaaatctaaatctacgtctctcgttaaatgattgataacccatgttccattaattttaggagcgagcacttctttaaaaatattagcttcttttctaaagaggaaaccgtccccggcaactccggcacaatggaaaacgccattgatcgtaccgtatttctgttttatttcttcaattaccggctccatgctgtttaagtcagaaacttcacagctgtagcaatcaactttagaacccattgactcgatagctctgatggacttcagttttctgcaaagctttaaatccgttccatcagcaatgatatcgtcccatcggctttgatcaggcagtttagagcgattgagcaatacagcattgacgttatgttttccagccaggtgctttgcgatctccaaaccgattccgccggtgccgccggtaatcatatagacaccgttttctttaatctccataccgccgtgtttcttatcctttatcggttcaaccgtatccaaccgactgatataccgcttaccatccctaaaggcgacttgatagtgtttcccttttgttcttaactcctcactaataatttccggtgaagtatgttcatcaatatcaattgctttacatgaaacattttggaactcctgcgaaataacacgtcccagaccaaacaacgcggcgcccaatggattgattgtattttcttctccggacacttctgtcacaagatcagaaataagatgcaaattaatattgcttttcatcttattcttacttaatccccggactaagcggaacaggctgtatacgcctttattctgcatgtcttctaaatctgttaatgattccgttccttggcggctgatagaagacatatgtataatgctgctgatattttgatcgtttatgctatgcaataattgaacatagtcttcttctgatccgctaattaggaatttccgcccatttatcttctgaaattcatccccaaactccacttcaataacatcatcgtcatgaattttcaactgttccagtatagatttataaatttccatgttgtctttaaataacagtataggacctgttacctctgttttttcttcttcaaaagcttcttgcgccatccattttaattgataaagtgattcagaactttcttcaaaaagggcattaatccgatttactttttttaatacataatcggtgatttctgcaaaaacatttccttctgtatctattaactgaatatcacacagctttgtctctttactgcttgcgttctttttgacaaatgcataaaaatgctgcggcattcttgagtaaatcttcacgcttttatatgaaaaaggaaggaatgtactatcgtcatcatcttctccaataaacacgttcactgcattatctagcaaagcgggatgtaaaaagacgtcttttaaatctgctgtaaattcatcagccaattttaattcggccaattgttcatcagggcccagtatgacttctttgaagttcagccacctcggtccgaaagtaaagactttgctgattaaaccatttttattttcataattgacttttatcttctctctattactgtcattcctaacagagtctaaatcaaacattgatacagagtctgttaatggaaacgcttttccttctgcatgtgtaatccaggtttctccttcctgactggctattataaattgaatacattctttctttttcttaatgattgtgtgtacaatcttattctcatcctcatttactgttaacggagtgaagaagataatatctcgtaattctaattgattgcttttatagtaagcggcacttgctcttcttcccatttcgatataagtcgttcccggaataacgcaagcccccatgattttatggtcacttaaaacccaatccttattcacattaaatgtcgttgaatagatcgtctcattcattgaatcagccaaacactggtcaatcagcgggtgactgatatttttctgatgcggcgcttgacctcttctgtcttttacttctccccagcataatgttctttcaaattggtatgtcggaagactgacaatctttctgcgctcatccttgtacatttttgtccattctacttttgctcctctgacatacaggttgcaaatttccgtaaggtttagcagtaaatattcatccccttcagtaagaatgtcatgtatcaaattgtcagattgagcattcattttgcgatgttcagataaggaaatttctccttcatccataatctgttttctatcagaaccaactttatggaaagaaaaatatacgcctttttctgatatttcattcaggttatgccctgcaagcctgccgatttttctctttaattcttcgtaactttttacaatcagagccaatcggtagccgtaatggccccgccctgtgtttgctgtatagcaaatatgttttacgtttttttgagttccttttttaaagaattcattatattccttgatgagtttcattaaagaattctctgttttagctgataaagtaaatatctcaaatgtttcatttgcaggaatgacctcttcaacctcatctccagcatcttcaatcactacatgtgaattggtccccacaaagccgaaagaactgattcccgctctcctcggtgagttatttttaggccattcatgggctttgtctgtaacaaatacaggtgacttcacaaagttaatcaatgaattcggttctttaaaattaatactcggagggatgacttgatgcttcatagacagaacgatcttgataagtgacgccaaacccgaaacggcaacggtatggccaatattagatttaacagatccgatcccgcaaaactgcagcttgtccgtatattttgaaaacgcattggaaatcccctttatttcaattggatctccaagctttgtgcctgtaccgtgcgcttcgatatattgaatggtttcgggatcaatttgagcattttcccatgcctgaaccagtacttcttcctgggcgatggcatttggagctgtcaatccatttgaggccccgtcattattaactgcactccctttgataacagcataaatatgatctccgtcctgcttggctttacttaaaggttttaagatgactgcagctactccgtcactgaaaaatgtcccgtctgcgtctttatcaaatgagtgtactttatcacttactgattccatcattgattttttggacgttttgaagcgcggaaagaatcctaatgaaattccgctgacaatagacatatcgcattctttatttttcaaagcattacaggcaagatgcacaccaagcagccccgagctgcaagcagaatccaaaaccatagaacttccttttaaatttaataaataattaatccgccccgccatcaaacccggccagttgcccgtcatacttgtcgattctgattctgtaatgtagcggtacaacgtattattgacatggtcttttccaacaaagagcgatgtgttgcttccataaattttgtcccctgcataccctgcatcttcaatcgcagtccataccgtctccagcaatactctgtgagacgggtcaatggcctttgcttctttaggagaaatattaaaaaattcaggatcgaacttgtctacgtcttctaaatatccgccaggtttccagttatctgcttgttcttccgtcagatatcctgaaccgagaaaatcagtaaaccctttattgtttacgatcggtttaatgtaattgatcatatcttttggatattccgctttgcagtcttctccattcatcagattctgccagtattcatctgtattgtttgctttcggcagtctgcaggaaattccaatgatagcaatatcttcattgctgcttgcagcctttaattcttttagcattcgctttgcttctttctggcttagcttatgctgtttcacttgttcaaatatataagattgaacgctattcattacggatcactcccgctttctttctaagaaaatttttgataggaagggtaataagatctacatttttaccttaaaatggaattcagttcccgtaataatgtgataggataggcaggctgctttttcttcattcaattcgcagcctgccaatatccattttgcgaatatattcttacaggcccaattcagttattttcggtctggatgaaatatttgatttgcttcgctgacttccatctctccggatgccagcttattcaaaattgcatccaggtcatcttcattgtcttcttcagggattcggtcagaagacttctgatcactgaagtgggattcaaggtaggttgacatctccttaatggagggatacgtaaaaatatcagaaacatcaatgagagaaggccattctttctctatttcttttaccagatatatcgcggatattgaatctccgcccaaatcataaaatttatcagttatactgatttgttctaagcctaaaacttttatccaagctttcattagtttattttcaatatcgctgaagctaaatgtctgatcggttttcgactcaacagatttttttacaatcgcctgctccttaaaagtcaaaatatccggagataatcggaaatgaatttgatcttgatttaattccagtacccgatgatcaatttccccgatgatcacattccggatgtccttttgcatgacttcatcgaaggcacgtatcgcttcagctgaggtaatcgtcttaaagccgttttcatctttatgttcgtttccggccttttgacgctcttcaatatattcggcaagcatgcccacatccgaccagccgcaccaattaatcgtaactgttttttcatccggtcttcttcgctgtctgcgttctgcaaaggaatccaggtaggcattagccgcagtataatcagcctgccccatactccccgcaagtgctgtgatagaagaaaacattatgaagaaatccagatgctcatgctttgtcagctcgtttaatatccatgttccattaactttcggtctgagcacgttatcaaacacttttttttcctttctgaaaataaacccatctccagaaacaccagcactatgtatgacaccgtggattgtattgtatttactctttatttcctcgaatacatgaatcatttcactttcatttgcgacatccgccttatagtaatctaccttagaaccgctttcttttatttcttttagagcatcgattttcttgttgtttcccttctccatgttgatctgctgctcggagcgtccaatgaggattaattggacattttcttttgatgataaatacttggccatttctaatcccagtccgcccataccgccggtaataacatatacaccgttctttctgatgcttattttcccttcccgaattacggataagtcttcagtctggagctcttgaacgtatttatgccggtctctgtaagcgacaagctctgactgtttttttgagttgatttcaaacaagatgctttccgccataagattttgatccaaatctatgcatctgacacttacacgcgaatattccttttcaattacttttccaaaaccgaaaaatgccgcgttatgcgggttaatgtctggttcttcaccgcttacttgatgtgcaaggtctgcaaacagcatcagttctatgttattttttgtattttctacaagtgattttgttaaataaaataaactgtctacccctgaggatatttttttctgaagctgatatatgtttttgtctttctcattgctgatagacatcaaatggacaatctgagaaaccttttcactttgaagagcttttacaagacagtcataatcttcttgagaatcactgacagtataatgatggcttccgattttagagaaatagtcaccctgttccgcgacaatcacagttttcccttccagttctaaccttcgaatgatttcctcggataaactgcagccattattcttaaataataaaataggatgatgaatttctcgcatctcgtgtgattgatcgctttctcttatccaagatagcttatgatatatattgtttcttttagtcttttcagctgctttatgcaccctttttacgatgtaattgttgatttcaccgaaaacttctccagtgtcattcagcaggacgatgcgaaacgttcctgtttccccgttgcttcggctctttttcttgatataactgtaaaactttttagaagcagagccataaatcttaaattctttataaaaataagggagataggtttcgttatctattgtgaatgtcccggcattaacggcacaatccatcatcgcaggatgaagcgaaaactgaacgaaatcactctcatattctttcggcaattccaattcacatagaagcctgtcgtcgtctctgtagattgcgttggtgcatttccatctgcctccgacttgaacgatgctttccggtctattggtatcttctatatgataaaccgacttgtattcatcggtgtttatttccgtcaatggatgattattacgttgaatgacataaacagaattaaagcttttctttaaatcctcaatgtcatatgtttcccgtaccggttcttctttcgcaatgaccgcttccgcgtgttttatccatttatcgccggtcttacttatcacactaaactctaaaacgctgtcctttttctttatgatcgtatgaacttctttaacttcatttgcttttacctttaactgatttgaaaacgtaacgtcttttaacagaatgccgacaggttcgccgaagtattttcttcccgcttctctagctgtttctatataaaccgttccagggataacgtaagaatcattcactttatgttcatttaaaaaccaataatcagtgacattcaaatgggatatatacacttccagattcagtgactgcactgcaagattgctcaataaagattgttttttctcatcggctgaagggccgtctgcagccagctcagcccataatctttttccgctgaatttgtatgtcggcaagctgaccttttgaaaattcatctcgctataaagatcttcaaagttaatattcgccccatcacaatacatttcacataaaatatgtaagtcagaggttggaatattagagacgtcttgtctgactctttgaatcacattttttattgtttgagtattctgcacactgtctgtatgcgtttttcctataaactttgtttgatttgttatcgattgaaagtatatatttttctcccgatacgttttccattcagagcatgataaaaactccagcttttccagcagttccgcgacagagcttattaccatagcgagtctgtatttgtttggcaatctcccagtgtttgctgtataacatatatctcccagattcacatctgtttctctctttaaataatcaatatgatctgtaagcaagtgcgcgagagatgttttagtcctagctgatacagtaaaaatatgttcagataaaacggattgatcgactttttcaactgcgggtgcctcttctaaaatgacatgacagtttgtaccgctcagcccaaaactgctgatgccgcacctgtatactccgctgctctcccatgctgaaacggagtcattgacgtaaacaggcgattcatgaaaattgatatttcggttcggcactttaaaatgtaaacttggcggaatttttttatgctttaatgccattaccgctttaattaaacccgctattcccgccaaactatcaagatgcccgatgtttgttttgactgaagatactgcacagaactgttttcggtctgtatattttctgaaagcccgttgtaacgcatttatttcaatcggatcccctaatttggtccctgtcccatgagcttcaatatatgtaattgttttaggatctatttttgcatttttccacgcatctactattacttgttcttgagctgctgcgttaggagcggtaattcctactgagctgccgtcctgattaacagcgctccccttaatgactgcatagatctggtcatgatcacgaatcgcttgggccagcggcttcagcaatacggcagcgactccttcgccgctattcgtgccgtcagcagaatcatcgaaagtccttacagcaaaatcagatgaagaattcccgatatttaacctgctctcctctattgtctttgggaatacttttatattcactccgccggctaatgccatatcgcaatccttatttcttattgcctgacaagccgtatggagggcgacaagcgatgaagagcatgcagtatcgattaccattgctggccctttaaaatccaagatatatgacagtctgcttgcgataactgatttaatgttacccgcggtagccagtccgagtaatgattgatctcctttttcaagcaatctgaagtattcatttgagccgtcactgctgagtccaatgtatactcccgtatttgtcccacataattttccgccgccgtaacccccgtcttccaatgcgttccaggccgtttcaataaataatctttgtctgggatcaatcaactttgcttcatttggaaggatactgaaaaagtcacaatcaaatttatcaatctcatccatataggctatttttgtataggctgcatctttactgtacttggttccgctgttttttaatgactggtcagcatctttttttctgttcagaggaatgtctctgatgaactcttttccttgtaaaagtaaatcccaatattcatttacgtgattggcttcgccgattctgcatgataaaccgacaatggcaatgtcatctccggaaatgtctttggtcccttcctcgtttttttgtttctttacattaggagtttgatttgtaaaagcggccgcttttaagttacttaaacttataaagtctgttttcatttttttacctcgctgagaatcactagataggtgatcatacctgtcaaacttcaaagtcttcaaagtgtttttttgtgtttgtttcagaaaataattgattaaatctttttttctgttcatttataggggttttttttgttcgaaacactgacttcagcatttctactgccatatgcatttgttctcttgacggctgacgacctgatgtttcaagttcagcctgtatggcagctactttttcatatggttcgattacacctttggcgtattcctcattgttccagttgtaatttttagtagcaaccgcgatccctaaacttctcgagataatagaaaaaccggcttgcagtgaaacagattcgttcaaaagagtctcttttataatcttcacgtcctcttctttgtcgtagctgtacgatttgatgtcagcgatattgtttcttacaagattccttaatacagatttcggcccaaattcaatcacagtatcagtatgatttgcttctaaatacttcatgattcccatccaatttaccggttttacgatttgagttcccagtatgtcagccatttgctgtttatctgaatatggaagagccgtcacattagataaaactttgtattttggagttctgagatcatacttttttaactcatggctgaatttttccgcagcaaaacccatgatcggagaatgaaaagcagcacttacatttaatttaaaaatgtctgctcctctggctttaagagtttcactaagctcttcaactgctgccgcttctccggataccacaacatctttatatccattgtagttagaaacagcaatcgtttttcctcttgaagagagagattcgcactcttcttctgctattctttcatccaggttcctgataacagccattgctccggtcccttgttcggcagcttctttcattaataatcctctggctctcaccagctttacagcgtcctggaaatccaaaacgtcactgcaaaccaaggcagaatattctcctaaactatggccggcgatatattcaggttcttttccgacctcttccatgtagattctgaattgtgcaatacttgttgccaggatggccggctgagtattttctgtttgagatagctcagcggcacttccatctatacataatttcttcaggtcaaatcccaatgcatcactggcttcgtcatacgtttttttagcgataataaaattgtcacataaacgtttgcccattcctgcatattgagatccttgtcctgaaaataaaaaacctattttcgacatttaaatacctccaaagtccctataatgcctgatttgccttacattctgccgatcagcaaaatgtaaggcagaaccggccgctttatattgaattgtctgctttgtctgctgtaatcacttgaatcaaattcatgtagttataaaataaatctttcattttgtgctcatttagtttctgatggttatatataaaaacgatttctgcttcggatggcttttcatgaactgcaaaaaccagatcatataattctgagtactctttttttgattcattactaatataaaaaagaggaaaaacatcttgggccgaacttgatttcttatagtgagtattcaaatcgtattgtgaatcctcttgattctcaatctgctccttcgccatacgaataatatcgtgaaaattctcgatatcagacagatcaaaagacagctgactcatccgatcatctccatgacccgaaaattggatatgaaccaagttttgctggctgacatcagctaataaaaatacataacccgctaataaaacatgagaaatatcatatttgtaggtattgcatattgtttttaaaccatcataataattcgcatttaccgcatattcgtgcatggctgtatgactttgtccagttgattccgagatgtattcaagcggtaaagtaataggaatgatttctttttccaaggacactgctatctccgcaaaggctatagctgattctatatattcggacaatctgtaaatagtcggatatgcaaacaagtcagcaatttgaatttgttttggatacagcttctgaagctcattataaactgcaacgattttgattgaattaccgcctgcttcaaagaagttatcatgtattccaggctcttctatttttaaaacatcggtccaaacacggctgatacttttttgtacatccgttaccgcttcctcaaaaggccggtcaaaacctgttctatctataacaggttcaggcagtgccaggacatttatttttccgtttgctgtcagcggaatttggtcaattttcataaagatctgcggaatcatatactcaggaagcacaggtgataataacttaataaattctgaaggatatacagtgctttctgccacataatacagaactaaatcttggactcctgcggaatttgtttttccggcagctacacattccttaactttttcatgttggtttactatgctttcaatctctcccaattctatccgataccctctgatctttacctgattgtccattcttccgataacgtccagttcaccatttggcagccaccttgctaaatctcctgtcttatacatcttggttcctttaacaaacggattgtctacaaacttttgcgcagtcaaatcttcttttcctaaatatcctctggccattccggctccagcaatgcataattcgccagtactgccgagcggtacagtgtttccatcatgatctactatatatatctgtgtattcgcaatcggcttgcctatatttacactattttcattggttaagtctttcacagaagaccaaatcgtcgtctcagtcggaccgtacatattatagatcttcagatttttatatttttttagctcaaataacaattcccgttgaaatacctcgcccccaaccatgatggtcttcaatttctgaagactctccgtactgttttctgcacttagcatcagctttaatctggatggcgtaagctgaatagtattgacatcagtctcaacaacgatcttgtttaacaagtacggatctctttgttccgcttcaccggctatgacaactttcagcccttgagttaaaggcagcagcgactctaatccgaatatgtcaaatgagcacgtggtgaccgaaagaaggacattgtcttgtgaaaagctgatcctgtctgttattcccttaataaagttatgaacggcacggtgctctacggcgacccctttcggttttccggttgatcccgacgtataaatgacatatgctaaatcttcggccctgttaataacatcaatgttcgtctccaactgatgtaataaatcctctgaatctatgttaaatatggttccgctgtacgttaattcatttggaagtccttcttcagttaacagcaggccgcttttactgtctttcagcatataattgatcctgtctgccggataatcaggatcaagcggtaagtagcatccccctgcctttagtattcctaatattcctataatcaatcggaaagaccttcttaccaaaataggaaccacaacattctctttgatgccgttttccctgagggctcttgccaattgatttgccttattattcagctccttataggtcaagaagtctccgttccattccagagcgattgcatcaggtgtccttaaagcttgctcttcgaagagctcttgtaacgtcttttctttcttatatgataattccgtgcagttgaattctttcaccagcttttgtttctctgtctcatttaccatatcgatctgagaaactattacttcatgatcagccgctgcctgctgtaagatgctaaccaggttatctaagattgaacttaccgtttctttactgtaaacactggcgttatatgtgattttcatatgcaagtcgtcaccgggagcaattaaaagctctaaatcatagttggtttgttcaaacccatgttcagcagttatttttacactcgaacgggctgaatcttggaaaagatcctcactcaacgggtaattttcatacacgactacgtgattgattaatttattcttcatacttgtcaaagactgtatgtctgccagagaacaataactgtattcgttcgcttcaataaagtctttatttatttgtttagccaatgaaataaatgatgtatcacattctcttttcactctgattggcactgcatttataaataagccgaccatattttcaattccgtttatctcactcggtctgcctgaaacaatggaaccaaataccacatcatttgtattgttatatttctgaagcaatatcccccatgctgtttgaacgatagaatttaatgtaatgctgtttgactcagcgatttttttcagcttagcggcggtttcaccgttaagcgctcccagtttttgatcatgctgatactcgtcagatttcaattccagttccggaaatgagatctcttgttcatatgcagaaagatattccttccaatattcaaatgcacggtccttgtcctgctgatcaagccattcaagataacgactgtacggtacaggtgattcttgaaggagttttttcccttcagccacgtcaccatatagatccataagctcttttaacaggataccgacactccagccatccaaaataatgtggtggaaactgtatatgactttaaatttatttcttcccagcttgatcaccgatactctgatcagacaatctttgttcagatcaaacggagtattcctgtctctcaccttgaattgccctacaaaggcatccttcttctgctcctcccattggctgatatcatgatattgaatgtttagttttctttcttttaaaatggcttgtttaaatacacggaaaccgttatagaaaaatgacgttcttaatatttcatatttagcaatcagcctgtttaatgcgtcactgagaacttctgtattcagatttccttcaactgttatttcactttgttcgaaataagcgctagattgatggtcaatcacagcgttatacagcatgccttcctgcatcggtgaaagagaatgaattttttctacttcagcaccgcttgcaagaatttgatttagctcctctatttgaagatcgggatccccataatcccatggagttttctcagatattttcttattcacacaatgttctatgatctgatttattttcaattgataggctttcgtaaattgctcaatcgtctctcgtttatattggtttgcactgtaattgaacgtaaacatcagcctgccatccatgatatatccatttatttctatactatgtgtctttttatttcttccagatatgctcgttccggcggacaaaggtgatatttgaaataggttgctgcgatcttcttggccaaattcacccaagtagttaaaactgatatcaggttttaattgaagatgaaccgagtccgacaaatatctgagtattccgtaaccaatcccgttatgggggatatgtctaagcatttcctttgtatacttaatggagcttgataaactattactttccgtcatatcgagaacaattgggtatattgtcgtaaaccaacctattgtgcgatggaccggggtttttataacactttcacggccgtgcccttcaagattcacaaggatcttctcgttgccggtccattctttggctgcaagtcccagtgagcaaagcaatatatcattaatttgtgtatgatatgctgcatttgtatttcttaaaagtgtttttgtttgatcctctgttaattcaattttaatttctttactatcttcataagagcagctttcggcaatgaaatcctttggaagaggttcaataatagccgtttctatggtctcccagtacccagcttccttttgaagagccttgctgtttgcatattctttcaattgacgcgcccattctttgaacgatgctgttttagtttccagctccaccttgttcccattaactgtttgaagataagctgtttcaaaatcttccaataggattctccaagatactccgtcaatgatcatatgatgaatggttaatagaagatgatctccgtttttggttttaaataccgccagttttattaaaatccccttttccaagctcaattcgttctgcatacggtcagccagtgattcaattgccatggctggatcttctgtttgtgtcatatcaaatacttctaaagtaaatgtttcttttgcctgtttaatgcccctattccattgcttaatttcaccgttttcctttttaaactgcatcctgagggcatcatgatgcctcaccagttccaaaaaggccgtttcgattgctttttcttctatgccggactttttgtaaagcataaaggcttggttatagtggttttcttgttcaaatctctgttctataaaccatttttgaatcggtgtcagatcaacgtctccttctacaatcgactgatctgcttgtatatcagctgattttacgtgagcactcaagtcttttatgtgcggatatttcattaaatctctgacttccagttttaagccgtatttttggagttcggaaactactaaaattgatttaattgagtctccgccgatctcgtaatagttatagttaatcccgattgatttcatccccagaactttctcccatacgcatgcgagaatttgttcctttttatttcgcggtgcttcatatgcagactccaatacatccgcaatatctataatcggcaatgatttcgtatctatttttccgtttgaacttaacggcattttttcaatctggaagatataacttggcaccatatataacggtaattctttagacagattttcttttaaagcataaacatctatttttttgtcggaagtaacataaccgcagagatatttatccccatgttggtcatctctcgctacaacaacagcctctcttatgtgactcattttcagaagccggttttctatttctcccgtttcaatacgatatcctctgattttgacttgatcatcaattcttcctaaataatcaattgtcccgtccggcatccattttgccatatcccctgttctgtataacttagccccgggttcaaaggggttatctacaaatttttctgacgttaagcccgctttatttttatatccgtctgcaagtccttctccgctgacacaaagttccccggctgcccctaaaggaagtaattccaattgttttcctaatatataaagcttagtattatccgcaggtttgcctattgatactgcattgccattgtctctttcaatatgatattgatgaatcatacacccgactgtagcctctgtcgggccgtattcattgtagattttgacatgaccgttaaatgcaccgtgtatcttttttgcaagcccggttttcagctcttccccgccgacgattattttttttatctttgacgtacttaaatctacattctccagcaatctcaaatgcgtcggcgttagcttaataatatccgctttattttcttctataattcttctgatcagaagagccttgtccggtccctcataaataataattttatttcctgaaataagcggtgtataaattgaagtaaccgttaagtcaaaagaaatagaagaatacagaggaaaatcaatatcttcatcatttacatatatcttatttgcccaatgaatataatttaccacgcctttatgttttaccatgacgcccttcggcagccctgtagtccctgaagtataaatcatgtaggcaaggtcttccgggcaactgacattcggcagattacttctgttatgcatatatagagtaggatcacttaatgataaaatttctttattgaatgtaataccacctgacaatccgttttgaattaggagaatgtttgcatcactgtctttcagcatgtaatttactctttcatcaggatattcaggatctatcggcaaatacgctccccctgctttcagcaccccgataattccgatgatcatctcaagagatctctctgtcatgattccgacaatgctgttttctctaattcctttttgtctcaaaagattagccaggctgtttgatttctcgtttagttctttataggttaatagcgtatcttcttggacagccgcaatacgttcaggtgttttttctgcctgctcttcaaataattgatgaatcgttttattccgaggaaattcagctgccgtgtcattgaatatatggagcaatgtgtgcttctcctgttcaggaatcaaatccagtttcattaaaggttgatctaggccggcagctgcactttgtaaaagcttcgtaaaatgggcacccattctctcggctgtttctttttcaaataattgactggagtattccaagtggaacttaattcctttatcaatttccgtcgcggttaacgttaaatcgaattttgaaatattgatctcggtttgaatatgctcttccggatttggatccaagtgattttcaataccgtaatctgcattttcaagtacaaacatgacatcaaacagcgggttccggctcgaatctctttttaccccgagtttttgaacaatattttcaaattggtaatctgtattctcaaaatcttttaacgtatgatgtttgacctcttctaaaaacgctctgaatgttttatgttcctcaggaaaatttcttatggcgacggtattgacgaacatccccaccgtattctccagttcggtgtctgaccttccggactctgccgttccgatgatcacatcctgctgaccgctgtattttgaaagcatgatattatataccgccagcagcaccatgtacaaagttgttcctgtttctttcgccaccgactttaagcttgatgttaacctttcatcggccgtaaagctgactcggcttccttcaaagcttttgactctcggccgctcgtaatcagtctgcagattgagaatcggcagatctccgcttaaccgcttaagccaatactcctcttgttcctttaacgcctcttttgttcctgagcttacttgccattctgaataatctttatattgcagcggcggctgttttagtttatgacccgcatacagcgcattgaattctttgcggattattccaaccgatacaccgtccgcagcgatatgatgaacatctaacagcagcagattccggtcttcatacgttatgagtccggctctgattaacggtgctttgtccaaatgaaagggtctgataaactgcttcacatatggtcgtatcccatcagacggcagcttctgataattaaattcgagctcccatgtatcgtgaataatctgaaccacatcgccgcttacaacatcgaaacttgtccgtaacgcttcgtgtctgccaataatctcttgtagaactgattcggcttttttcacatctaattttccgtttagttcaatcataatcggcaagttataaacgatactgtctttatccgtctcccaaagggcaaacattcttttctgagcagatgacgcttgataagaagactgctttctcgctttactgatgaccggataattctgtttatcccgcttttgaataagacggctcaactgtttgatggtaggctgctcaaaaagctccttcacctttatatccgtgccgaatgtttttctgatgcgggaaatagtgaacgcagctgttaaagaatgtccgcccagttcgaagaaatcttcatttatactgatccgtttatgcccaagcatttctttccaaatttcagctagtttttcttccgtttcatttgccggagcttcgtattgaggtactgacaaccgttgcaagtcaggaagaggcagctcttttcgattgatttttccgttagctgtaagaggcaactctttcagttgtattatgaaactcggaatcatatacttcggaagaacctgtgccaatttctcctgtacgaacgagccttccatctcaatgtccccagtaatatatgcagaaagatatttctcctctatataaacaaccgccgcttcttttataccttccagctgtaatagttggttttcgatctctccgatttcaactctaaaacccctaattttgatctggttgtcaatccggcctaaaaattctatatttccatccggcatccatctgccaaggtctcctgttttgtacatttttgctccacgatgaaaaggattatcaataaatttttcattcgttaattcttcattattgacatatcccgatgctaaacctaccccgctgatacaaatctcaccaggtgctcccacagggaccagttgatctgaacgatccacaatatagatattaataccgtgaattggtcttcctattctattgtatatttcacagttttgaatatgatctagatcaatgctatgtgcaatacagccaacagtgctttcggtcggcccgtaatggttaataaacttcatccatctgcatttttcagcgagctttttgacgttgccgatgtttatgctttcgccgcccagtataataacttttaaatcaggacaagacgccagcatgtcaacatcctccatcaatgttgaaaataaagtgggtgtcattttaagatatgtaatactatttttatgaatatattctattaatgatagagagtgaagatacacttctttatcaacaaagtggacttgtccgccaccggataaaactggaaatatactggtatagcataagtcaaaactatattttgacgtcactaacgacctgctgtcagaatttatgtttatttgatcacatacccataatgaataattaactaatgatttatttttcaccttcacccccttcggttttcccgaagtacccgaggtatatataacatatacctcgtcctcgagatcatactgaacatcagggtttgatgtattttggctggtataaatcgatttatccgtaatatccaaacattccgccgcaatgtttttatcagctaaaaagcacaaatctgtaatgaggatatcagctttgctatcttttaaaatatgatttatccgactgaccggtgattcatcatcaataggcagaaacgcacttccggtttttaaaattcccagcatcccaatcattgaatattctgaaggacggatcatcatagccgtaatgctgttttttcctgcccctttttccattaataatgttgcaacttgatttgccttttcgtttagctctttataagtgatatgctttcctgcatagacagccgctgtttggccaggtgtcttttccgctcgttcttcaaaaaggtcttgtatcgttttattcaccgtataattagaggactgcttattaaaatcctggagcattccgcgctcttcttcatttacagcgctgatgtctttcaggacacgcgtaggatcagttgccacttgctttaacacatgacagaaattaacacctatacgattaatgatatcttcacgataaacattattgttatacgtcatctctgctttgatttggctgcctggaataataaccagcccaaagtcatagttcgtctgttcaaacacttccatatctgtaatccttaaagcatcagttgtattatcgaccgccttgccatagtcatcaacaggataattttcataaaccaacatatggttgatcagtttctctttcatctttgtaagagcttgtatatccgctaaagaactgtaaccgtatgatgtattcgctttgataaagtcactgttcagcttttgggctaatgctataaataccgtatcaccatcgccttttactctcagaggaaccgcattgataaataaccccaccattttttctatgccttgcactctgcattgtcttccggaaataaccgcaccaaaaacaacatcatccacgttgttatacttctgcaaaagaactccccatgcagtctgaatcaatgcacttaaagtaatgtgatattgatcagctgcagctttcaacatcgaagtacatgtttcatcaataatgaatgttttcttcctattattgaaaccgccctcatcagcagaactttggaataccggcttgctgctcatattcatttagataatccccccaatattctaatgcggcacttttgtcctgattatccagccattctaagtaggtgctgtaaggctcggtatgctgaagcactgtctctcttccttcttttaatgacgtataaatagtttttatatcattcattattaaactcatacaccagccatccataataatatggtgaaaactgaacagcagtttatattctttctcatcagtttttaatacggttactcttattaagcaatcattcgtcaaatcgaatctcgttcccctgtctttaaactggacatttttaagccggactttcttttgatattccgagaaagtgctgatatcttcaaattcaattttaacttttctctctcttagaacagcctgtttaaacttacttaatccttcatgaaaaaagcatgttcttaaaatttcatacttctcgatcagcatattaaaagctgtatttaatctgccaatatcaagctgaccggataaagaaaatgtaagctgctcaaaataggcttgtgaaaacggatcaagcaatgcatgataaagcatcccgctctgcataggagtcagggagtggattttctctatctcttttccgcttgataaaatctgctccaaatctccgatggataaatccagatctccatagtcaaagggtgttttttcaggaatttttttcattccgcaatgctgaataatatcgattaaccggtttatataggattcggttaatgttttaattgtttcttctttaaactctttcgtactatagttaaattccaactgcagttgaccgtccataataaagctgttgatttcgatggcattcaattttttattagataaagaaacacttgtaccagatgatatatctgcatgctgaaaaacagcccgctttttttgagagatttctcccagatagttaaacccgatctcaggctttatcgtaaaactgatgtcttttttatgtgccggtgccgtcaagtatttaataattccgtaaccaatacctttatgaggtattcttcttaaatactctttcgtattttttatgcaataaggcagatcatcactgtgctccatatccagcacgatcggaaatagtgaggtgaaccagccgatggttctttctattgaaatattttctaatatgttctctcttccgtggccttccagaccgattaaaaccttgtcaagtcccgcccattcttttactgccattcccagtgaacaaagcaagatgtcattaatctgtgtgttataagctgcatttgtattcctctggagcttatcagttaactgctttgtaagactgacagtaatggtgcggctttccttaaatacactgtcagttttattgaaatctctcggaatttctttaatcttcgttttctcgatattctcccaataccgaagttcctttcttatctcacttccgtttgcatattccgccaatttacgtgtccattcttgaaaggatgccgtttttggcggaagaacggccggctctcctttttgcagattgttgtagacctgctccatatcttcaagcagaattctccaagagactccgtcaatcaccatatgatgtatagcaataagtagataatcgcccctcattgttcgaaataaaccaagtttcattaaaagtcctttttcaagatccattccgctttgtaactgatcggcaagtttttctattgtatttttgtaatccgtatcagcaagcagatcatatatgtccagagtaaaagtatcccgggcggcttggacatctctgacttcttgttttatttcgtcattttcggctgtatatatcaacctcaaagcatcatgatgctttactaataattcaaatgtctttgccagagcgtgttcattaattttttctttcacttgaaacatgaatgcctgattaaagtggtgaatgtccgcaaagtcattctctataaaccacttttgtatcggtgccagttcagttctcccgctaaccgggctctgatctgtttgagctttatataatttcacgtgtttactgaggttttttatttgcggatactgcaaaagatcttttacctctagactgagactgtatttttgaagctttgatacaatcagtatagattttattgagtctccgcccagctcatagtaattatcattaataccaatatcatcaattttcagaacttccgaccaaacatttaccagaatctgttcgacttcggaacggggtgcttcaaggtgctcctttatatgtttaggctcttctatttctgcaagtgctttcctgtcaattttcccatttggtgtgagaggcagctgttcaacctggatgatgacaccgggaatcatatattgcggcaaaatgtcacccaattgctccctcaaagctgctccggatattttatattctgcggttacaaatgcagaaaggtatttgtcaccgtgaaggtcgcacttatctataacaactgcttcttttatcccgcttattttcagaagctggctttctatttcatcagtttcaatccggaagcctctgattttgacttgattatcaattctccccaaaaattctatgtttccgtcaggaagccaccttgccaagtctcctgttcggtacattttagttccggactcaaatggatgatcaataaacttctcacgcgtcattttctctttattgagatatcctcttgctaagctgtcacccgacacacacaattctcccgctaaaccaataggcacaagattgttgttgtgatcaattatgaaggctttcagatttctgatcggcttaccgataggaatggtctttgccatcgccctctcagcttctgagtatctccacattgtagagcagattgtcgtttcagttggaccgtaggcattaatatagtctattttattcacgatccggttcaaggattttgtagatatctgagaaccagcagtaattaagagccttaaagctgataatccgtttatatttatatggttgatgtatacaggcggcaaagtggctacagtaatgtcatgccggttaatatactcttcaaataatgtataattattgatgacttgacttgaaaggatgtgtagttccgctccggtcaacagtgccatactgatttcccacactgatgcatcaaatgaaaaacttgcaaattgaataattttatcccggtaattgatattcatatcatgttcaaagacacttttgagattactgattccgatatgccggatcgttacaccctttggttttccagtcgttccagaagtataaatgacataagcaagatgttctgcggaactcatcattggcaggttatgccgatctccggtgtaaagagaactatctgttaaatcaataaccttcccgtcaaacggaatattgtcagcctgactattctgcactaataaaatgtcagaaccgctgtcttcaatcatgtatttgattctctcagaaggatatcccggatcaattggcaaaaatgcgcctcccgccttcagcacacccaatatgcctaacaccatctctaatgatttgtcagcaacaatacctactattgactcttttttcacccccattttcattagtattctcgccagactatttgatctttcgttaagttctttataagttactttattattttcatacactgccgctattctttccggtgtcttttccgcttgttcttcaaacaattgatggattgtcttattatgcgggaagtcggctgctgtatcattgaatacataaagcagtttatgtttctcatcatccgttatcatattcagtctgcagattgccgtgtccggttctgatacaacctgttgtaaaagccgggtataatgagcacccattctttcgactgtgtctttcctgaataaatgattgcaatattccaattggaagttaacgccttcatcggtttccattgcagttaacgttaaatcaaatcttgatatattgacctcagataccagtaaatttgattctgctgtctcttcatttcctccgaatccgtaatccttactctcaaaagtaaacatgacatcaaacagcgggttccggctcgaatctctttttaccccgagtttttgaacaatattttcaaattggtaatctgtattctcaaaatcttttaacgtatgatgtttgacctcttctaaaaacgctctgaatgttttatgttcctcaggaaaatttcttatggcgacggtattgacgaacatccccaccgtattctccagttcggtgtctgaccttccggactctgccgttccgatgatcacatcctgctgaccgctgtattttgaaagcatgatattatataccgccagcagcaccatgtacaaagttgttcctgtttctttcgccaccgactttaagcttgatgttaacctttcatcggccgtaaagctgactcggcttccttcaaagcttttgactctcggccgctcgtaatcagtctgcagattgagaatcggcagatctccgcttaaccgcttaagccaatactcctcttgttcctttaacgcctcttttgttcctgagcttacttgccattctgaataatctttatattgcagcggcggctgttttagtttatgatccgcatacagcgcattgaattctttgcggattattccaaccgatacaccgtccgcagcgatatgatgaacatctaacagcagcagattccggtcttcatacgttatgagtccggctctgattaacggtgctttgtccaaatgaaagggtctgataaactgcttcacatatggtcgtatcccatcagacggcagcttctgataatcaaattcgagctcccatgtatcgtgaataatctgaaccacatcgccgtttacaacatcgaaacttgtccgtaaagcttcgtgtctgccaataatctcttgtagaactgattcggctttttttacatctaattttccgtttagttcaatcataatcggcaagttataaacgatactgtctttatccgtctcccaaagggcaaacattcttttctgagcagatgacgcttgataagaagactgctttctcgctttactgatgaccggataattctgtttatcccgcttttgaataagacggctcaactgtttgatggtaggctgctcaaaaagctccttcacctttatatccgtgccgaatgtttttctgatgcgggaaattaacatagaagcctttaatgaatgaccgccgatttcaaagaaattttcatctataccgacgcgttccctgccaagtacagcttcccaaatctccgaaagttttttctccgtttcatttgtcggcgcttcatattttgtttcggacatttgagatatatcaggtcgaggaagtgcccgtctgtcaattttcccatttaccgtcaaaggcatgttatccatttgtttaaagtacgatggaaccatatattccggaagaaagtctctcagaaagtgctgcaattcaatctttgcgattttatgatttgaagtgtaataagcacagatatataaatcatcatcaccattatgatttactgttactgccgcttctttaatttctgtatgattgatcaatcgggcttctatctccccaagctcgattctaaaaccgcggattttgacttgctcgtcccgccgtccgataaactccacatcgccattttctaaataacgcactaagtctcctgttttataaagacgtgctgaaggatcattattgaaagggtgtgatataaaccgttccttcgttaaatcaggccgtcgccaatactctcgcgccagcccatctccgccaataaacagctcaccaggaataccaggcgctaccggttttaattgcgaatctaaaatgaatatttctgtaccagaaataggcctccctataggaagcgtactgcctttccaatcatgagggaccgggaaacaacaggtaaaggtcgttccctctgtcggcccatatccgttaattacttgtacctttccaagtgctaatactttttgaacatgcggaacggaaaccacatctccgcctaccaataattgctgaagcccttttaatgattctaactgctgatcaactactagagaaaataaaccggccgtcagccaaagagtcgtaatgttatatttttttacagcttctgcaatatcatcagccgtcggtattcccggaggcattatagccagacatcccccattcaataaacagccccagatctcgaaggtagaagcgtcaaaagcggcagaagctaattgcagaaacgtttgattctcatcaaataccgcataatcagtctccttcaccagccgaatcacaccgcggttaacaatacttactcctttaggcagtcccgttgagcctgacgtatacatgacataagccaggtcatccaaggaaccttttatgccaatattagatccatccatcttttcaatttcttctttcataccatccaaacagattacgccgtccccgtgaggcgggagttgtgactgaatgctttcgtttgtaatcagcaactctacacctgaatcttcgattaagaatgatagtctttgcttcggatattgagggtctaacggcacataagcaccgcctgactttaatattgccagaatactaatatacaaatcaaaagagcgttctaaagcaattccgacaaggtctccccgttttactccgcactcctgaagataccgtgccagctggttcgcacggtgattaagttctgcgtaacacattgaagagttttctagtaccaaagcagtcttatccgaatattcatcagcctgctgctcaaacacctccgaaattgttccaattttcgaataattatcttcccagccaaagattttcttttgcttatttttttctttcaggaatctcatatctttcactctgatattttcaggagttatcatagcttcaaggatcatctgaaatcgcagtgacaaatcttttatcatattttgagaatagaggcattcgttatagtgtatggctgtctctatgtattgtttctggtttataaacgaaaataggatatgaatagcgggattttcttgattaagtatgtattcttgaatattttcaaggactatcatgacatcaaaaggaaggccagtcattttatcacttgttcgagaattattttgggggctttccaatgcctgttctacggtgaattcgactttatgtatgatctcttttaataggtcttcaccatgaacagcatttttaagagtcaaaatttcttgctcagaatcaatcgttctgttctttctgaaaacaggagtcttgattacaatattttgtctttctgtatattgatttattaacaaagtcagtgccgctgttaatacgacatgcagacgttcatccgatccattgcagcatacattcagcttatcgcttaattgctgtgacaatttatatgtaagatttttcattcttttttctttagaagatttacttcccactaaaaaatgctcttcagtttttaactcaccaatactgtttttatctccctttatactttttgtcataacaaaaactccttcacttgatatcaaaattcaattcattcactgaattaaaacagcagaggctttcggtggatttttatgttaaactgcatcacaggcaataacgctcaccaataattgttgttgtagtctgacagtttatttatcggcagcaaaaaccattttttaatgatatagacccgtataaacactttttttaaaaaaaggataatgaagaagaactagccatctttaagaaatattatacaaatatttaagagttgtcaattagcagggaaaaacacctaagcacattaacccagtttttatttttcgtattaacataaaaaaaccgggacaaagtaacactcccgatttttcaatcaacaatttatctcaaggttttatttataatgtcagttatttcattcgaaaattgatgaataaaaaagtgatttccttcaaacgtataaaaattgcatttccctaaagtataatgtccccaattacatattaaatctgagcttatcgtcttgtcattaataccatgcaacactgttatatcacagtccataacagtcttattttcagaaataacatccttttctaacattttgaaatcacttcttaaaataggaagatataattgttgtaattccttgttatgtaacagttcttccgaagtcccgcccatatccatgattctttgcaaaaataaattatccggcaaagcatgaatcatcccctctgcttttttcgttttaggaatgccgcatccggaaaaaaatatgtgattgggcttcttctgctgcatttcagcaattttacaatataacttataaactaatcggcctcccatactgtggccgaataaagcataatcacactccctgatttgatcctttatcagatcatatatatcattaacagcctcatctatatgttcataaaaatcttcgttaattcttgtacctcttccttttaactcaataggatgtattgttaaagagtcactcattaaccttctccatttatagtatattgcacttgatcccctgcatacggaagacaaaatatttttttcataattcacctcagaaattttgtaataacccgataaaaaaacaccctgaaaaggatgtttttactatctcattttatatatgaaatgctcttgaaactccgttgatgatgaggaagattcctattactcttaaaatgatccttgttgttctgttatcttttccaaaagcaacttgcccgattttaccgataaatacattcatgagtacacctataattaattcagccattccaaatagttcttccatacccaatttcctcacgtcctttttgatctgttaattttatccgattattgttgatttaattttcttttttaatctccctgcttatcaagatgaaagatacaataatacttaataagccgacacttgcaaaaattacgatcggaagccattcagttcctaaggtactcttactaaagataatgttgtttaaagactgtattgcccatgcttcgggtgtaaatttagaaataacctgcatatattttggagcaatttccaatgagaaaaaggaaccgcctatcatcccgcttactgcaattatgatcgatgcggcagaagtaaactgcttttggcttctcataaatggaaccataatcatcgtaatgcaggtcaatgcaaataaataaacagcgagcataacagcgatggcaaagatgttatgacctatgctgatcttgagtaagtattttcccgcaagtattataacgattatatgaatgattccggaaatataagtagcagccattttggataaaacatattttgtatagtttataggcgtacttagtaatcggctgaaagtattattctctttttcatcaataagtgttcttaacccttgaataacaacaaaccaaataaacattacaagaaaaccaattaatctcacggtcgcattatcctgagtatgtttaccctggcttaatgttttgtcattcacttctattcctgaattgtttttcaatttcttgaaaatgttcttttctatatcttttgagtccgtatgcaactgcgcagacatatattgcgaatctttaactacctttttaagagttcccgcctcatttttgaccagctgctctaacaatgttccgctgccgttctcatagttttggatgattttcatttttatcttgtgattgtccgccaattcctttccaaaacctttttcaataacgaccccaaaaggaatatcctgatcatcgacttttttctttatttcattttccgttagctttataactttaatatttttatgctcttttatcatttcaatgagctttgcagcatagttgcttttatcagcattggctatatacaagttctctttgctatccgtatcttgggaaaaagagaacaaaaatgtaaggattaacggcactgaaatagttgcaaaaattgctaatctatttcggagcatcagcttcagctgatgtttaatcatggcaatcaattgcactactacgccaccttcttcctgttgaataccataatattaataaagacaaagatgagaccaataccaattagctcaagcaaatcaatatacatgccgctaaggccaatattctgtttgacttttaaataagagtttattgccttaccgttcggtatgatctcttggacaaccctcaagctatcaggcagtccgttcttaggaataaaactgcctcccaaaaaactaaaaatataaagaaccggagaagccatactggacaccgccacgtggtccttagcggtaaaaccccaaaacaatacaatgctgcctatagcaaatgcgtatactaccgtaataacaaaaatatcaaacaagttgccccagttcattcggaatacgacccagcttatcagaataacagcagtcatctgcattaagatcgcaaaaataatacctgtcaactttccaagcacatactgaatatttaaagtcggtgtagatttaattctgaacagcgtattattctgccgctcatcaacaatgctatgaacaagcacaaaagccgtcataatggaaaacataacaaccattgcaattgaataatactgcatggaatcgacaggaaccgcatttttatttgtcgctgcttttgggatatcagcggagatcccgtcattatcggccaaatcgttcatcattttttctattttttcttttggtacgctgccgccggggctgatatgttttattacttcttgttgctcagcactcattgttttcacgcttttcgtaaagccctccaaaacagcctgaacaatatttttatctatggtcttattattatctccaattaaatcgatatttgttttcccgttgttcataacggctttcgtaaagtgttccggtacatagataaaagctgcagcctttccttctttaactaatttttcaccgtcattgtagctctcagcttcttttaaatgaatgatatctttgagatctcctttcttaaaaactttatcctttaagacatcacctaaagaaacactctctcctgaatctgctgagtaaaaagctacatcaaatgcttcgatttttgaatctgaattactgaacacactgcccaatatgaggattagcagtgatggaaacagcatcagctttaaataaaatgacttattttttgttaacagcttaaaatcaagaaaaaataagttgaataattttctcaagatagcctcctcctactaatctcttaggtttttccctgtaatttgaaggaaaatgctttccaaatttacttcctcgtacttaaagctagtgaggtcgatccccagatttttgatatcatctacaatttcaatgatgtttctttccttcgtcgatacaagcattgaaatttgtttatgatctaccgtcactttatcaattcctgtaatgctgtttatccggctgagtgcctcttcatcagcacccttaaaagtaacagttaaagtgtcacaagcatttaagttttccttgagttcttctttcgttcctaaagcaataagagatccatgatcaacaattgccaccttctcgcaaagatactctacttcttccatatagtggctggtataaataacagtcattcctttttctttattcagcctttttactgtttcaagaatatgatttcttgattgcggatcaattcctacagtaggctcatcaagaattaataatttaggattattcattaacgccacgcctatgttgacccggcgtttcattcccccggaaaactctgatacattttgattttttttatctgtcagttcaataatctccagaacctcatcagttctttcttttagctttttccctttcagcccgtaaaggcttccgaagaagttcaagttatctttggcgcttaacgtttcatataaagctaaatcctgtggaacaacccccattattttttttatctcaataggtttttccttaagtgatttattatctactttaattgtcccgctggtaggtgcaagaacagtgctaatcatagaaaccattgttgatttgccggcaccgttaggacccaatagtccgaatacttctccatcttctacagtcagcgaaatattattaactgccgtaaagtcatcatattttttggtaagtttttttaattcaagcataattaaaacacccctcgtggtatttcggttcttttattttaacctgaatggaatatttttagaatttactatagtactcatttaccttattactttagttacgaatcgcatcgttactttagtcatatacggaaggtgtaagtccggatatattcagaagaaaatggaggaaaggaatttgatgaaattcctttctgattgaaggaaaaaagttgaatcacatatgcttttgtaaatataagctaagctccgttcggttgttcatttgaagtttttccagtattcttgatacataatttttgactgtgccttcagtaataaacagtgcttcgcttatagctttgttgcttttcccttccataatctgtttagcgacttctttttctctgggagtaagcaattgcaccagctgttccttttcattattttcttgaacaagctctttattatgttctaccgaatttagagcctttacaacttttagcgttaccttaggatttaacagaatattgccttcacatgctgttttgatggaatcaataatttcttgtgaatcagaatctttcagtatgtaaccatcagcaccgcttttcagtccagtaaaaatgtattcactatcgttaaaggttgtcaggataatcactttaatatccggatatctctctttaactagctttgttgcttcaatgccgtccattacgggcattcttatatccattaaaatgatttcaggccttatctgttttagcaaatctaataaatgttcaccattagaagcttcgcctacaatattaatttcctcgtgcagactcagaatcattttaagcccttccctgacaatttgctgatcatccacaatgataatatccatatcaatacctcctcacattccgattaaagatctgctatctcggggattacggcttccacagtaaatcctgaatctagccctgaataaaaatcaacctctcctccaagtgcggcaaatcttttttctattccgtttattccatttgacttattaatttcagaacatcctgttccgttatcagttatcgatatagagattttttcaaaagacttacgtatttttattgaaaaaaacgtagcatttccatgttttatcccgttggttatagactcttgtactgttttatagagacaattcttgatatctggatcagctgactctactttattgtccatatcaagctcgaattttatttcatttgtttgctgaaaattttcaaaaatctcattgatcgatttcagaagccctttttgaggagcagggtcattgagcaaagcgacagcttctctcaggttaataatacactccttcgataaatcatgtgacttattgatgacttgtttagcctcgccgggatttttacttactattttatcggcgaattcaagattcattgttaatgcgatcaaataatgccccagggaatcatgaagctcttgtgcaattcttgtccgctctttagaaatagttaactcttgaattttttgagaataattcttaagtttagtgtttacactttgtaattctttatttaatgtttgtatttttgctttttcgagcagtacgtttctaaacagataaataatagccatgatcactaaataggacatcaatatatctttcccgctggtccctgctgctttaagagctgtaaaaaaaataataaaatgcagacttactacagtccagggcagtttacgagttgttacaataatctcgatcagtaaaaaaatattatatatttgagaaccgagacagttaattttaaacaataaaatgcctgataaaaggttacttactaaaaaagatgcataatatctaaaagaatactgaccgcttaggtattttaatctgatatgatcgttgacgactaaaaaaatggtgataatcagcaggtaagcggattccgaagccgtaaaagttggcgttttaaaaatagaactgataatagaatataaggaaaaacaaataatggttttctctatgagcactcttgtactaattgaagaaagatttttcataataatccttcccgagacaacttgatataaattatattatacatatattgagaaatcataaagcgacaacctccacgttcagcacatcatacagctcatcaagcgaatgaatttcatacgtcgggataatcccggactcatttgctttctttccgggattaaaccagcacgtatccattcccgccatctgaccgccttttatgtccgcgctcaatgaatcgccgataataagcccgtgcccggcagaaaaaccgggaattctcgcaaatacataatcaaagtattccttcatcggcttttgaaaacccgtgtcctcagatacaaacacatctttaaaaaacggatacagaccggagtcgcccagccgcttatattgtgatcttgagacgccgttcgtcacgatgtataaatcaaataaaggactcagccgttcaatcagctcataagctccgtctatcatctggtgcccttcttctaagtattggcggtacgcctgattcatcagcacgccgtcggcttcaaggccgtattctttaaacaaaagggcaaaccgtgtattcaccacttcatcgcgggtcatttcccctcttcaaacgccttccacagcccttgatttaacgctttataacgggcttccacctctgccgtcagctccagctttgaaccttggaacaatttttgaagagcatcggtttctgaagcggtaaaatccagcagcgtattgtctatatcaaataataacgtacggtaatgactcatcgatgtttcccccggttctgctttttttaaccagtataccactcgcggacaagccgaaaaagacacccctgtaagagaggtgtctttttgaattatacagcgtcttctattttcgatttttcaccaggcatgcgcttgccgataccgaacgcataatagctgaccgtcacaatcgccaggaaaatcaccccgacaaccaaagaaatccgcgtatctttgttaaaccacatgccgatcaataccatgagtaagaaagcgatcgtcaaatagtttgtaaacggcgcaaaaggcattttaaacggatgcttatcaagctcagcgcctttcgctcttctgaaaccgagatggctgatcaaaatgacgaaccacggaatcattcccggcagcacactcgcgctgtacacataaacaaagattttcggaggcgcgatgtagttcagcacgacaccgatcacaagtccgattaataccgcaagcgtaccgaatatcggcacaccgctcgaagaaactttcttaaagaatttcggtgcctgtccgttcacgcctaacgtataaagcatacgtcccgcactgaatatcccgctgttgcatccggacatcgcagcggtaatcaccacaaagttaatcagaccggccgccgccgtaatcccgactttcgcaaatgtcgaaacaaacggactgccgagtgagtgaagctcattccacggatatacggtaacgattacgaaaatcgcaccgatgtagaaaattaaaatccgccagataatactctgaatcgcgcttcgcagcgttttttgcgggtccttcgcttcccctgccgtaattccgatcagctcgaccccttgataggccgcaacaaccaaagacaaagcaaagaaaaatcctgaaaaaccatttgtaaagaaaccgccgtgcgaccataaattagataatccgatcgcatgccctccgttaccgaaaccgaagaaaataattccgattccggccacaatcatcagaataatggtgacgattttgatcatggcaaaccaaaattcaaactcaccgaaagattttactgaaattaaattcgccgcaccgagaatggccatggcgataatgccgggaatccatgccggcagatcaggaaaccaatatttcatatacgaaccgacggcgataatttcagacatcccgacgatcacccattgaaaccagttgctccacgccgtcatatagccggctaacggatgtatatacttatggccgaatgtcgcaaacgaccctgtactcggctctacatagagcatttcgcccatcgcacgcatgataaaaaagataaagatacccgagatcgcataagccagcaggacagacggcccggtccatccgatcgtgctggatgaccccatgaataaaccgacaccgatcgtgccgcccagcgcaatcatctgtatatgacgagcgcctaagcctctctttaattctttgtttgccacttcgcttcctcctcttaacagctctgatatatgtgaaataatgaagcagaaggtgcacctgttgaacctaactcactcttcatttcccgcaatattggaaatattctatcttcctatcgttatataatctccaatttccttattccatcataataaattttcgtggaaaatacaattgtttttttcaggcaaacaccttacactctgaaccaacggactaaaaataaagcgctttcatttttattgaattgtgaatattgagataataaatgccgcagcctccgagaaacattatttcccaggagaaacgttttccgccccctatccaatattatttttgctaagcagaatggcgtaaagccttactctcttccattctcccttgtatacgccataatcctgcttaacccggcaaaaatcatgcattaatcgataaatgcctcattcagccgcagcaaaagccggccgaacatttctttttcatcgccggaccaatcgtcaagcatacgatgataccgctcaagacgcatctttttatcagcttttaacctctgtttgccaagcttcgtaatcgcaaacagactgacccgcccgtcagaaggatcggaaaaacgctggatcagctctttcgactccaaggccgctgcctggcgtgataatgtggaaatatccagcttaaatgattcggccaattccttcacacgcgccggcccgaattcatccagctgccgtaataacaaatacgcagccctttccagatgtccgattttacggtcggagttatcaagataaacagctctcctgatgaaagtggtgagttcatattcaattaattcaatcggatcttgttttgacaaacgcctcactccttacattgacaacagcaacattagttgtataatacaaacatatgcacatttactcagaaaacatatagaaagattttgcatacatatatttgtatagtacaaatatatgtgccaaaagtaaagaaacttatagaaacatcaagaaagggggaagctgctcttctccaaagaacagcatcgttgtgaaagtcatacgcatcatcttgcaaatcattattttattcgcattttcctttatcgggggagccgttcagcagttctttcacctgcccattcccggaagcatcatcggtttgatcctgctgatcatatgtttatcggttaagatcattcccgtcaaaatgattgaagacggagccggatttttgctgtcttttcttccgctgttattcattccggccatgacgggcgtcatcaattacccgtcactgttttccgccagcggggctgctctgtttctgatcatcgtgctgagcaccatcgtcacaatgatcgccgcagggtacgccagccagctgttagagcataaagccaatcagagaaaggagaaaaagaagtgcagcaagcatgtatcgcaatccttataattttgttcacggccgccgcctatctggctatggtgaaattatatgtgcgctttccatacccctttctcataccggttttgacgactacgattttcattatcgccgtgctgcttgtttttcatattccgtataaagactatatgatcggcggacaatggatcaattcactgctcggccccgctgtggtggctttggcatacccgctttataagcagcgccgggtgttaatcaagtatatgtttccgatcatcggcggcgtgttggccggtttattctccggaatggtcagcggcctgctatttgcagagctgttcggcatcagccggagtttgattttgtcaattatcccaaaatcaattacgacgcctgtcgccatacagattgcgtccggtatcggcggtgtcccttccatgacagtcgtgttcgtcatgatcgcagggttttccggcgttatcttaggaccgctgcttctcaagtggatccgcatccgcagctcactcgggaaaggaattgcattcgggagcgcctcccatgcgctcggcacctcaaaagcaatggagtacggagaattaacggtctccatgagttctgtttccatgacgctctgcgccgtgttagggtcggtcttcggccccgtcgtagcatggatgtttcaaatttaaagccggcggttctccgtcagcttttttcatgtgcggatcatctcatttccttccattattatgtttcatttgtaagaataatggtaaagtagaaaacaaggagggatttaatgatgactggggcaattccgcaaaagaaactgcttgatgggacaagcattcccgcgatcggcttcggtacatacgctcttaatggaaacaatggcgttcatgccattaccagcgccattgatatcggctaccgtctgattgacaccgcttataactatgaaaatgaagggacggtcggagaagccatccgcagaagctctgttccgagagaacagctatacgtgacgtccaagctgcccgggcgctaccatgactatgacaaagctgtacaaaccatccaagaatctttataccgcgccggtctggactactatgacctgtatctcgtccattggccgaatccgaaacaagaccgctacacggaagcatggcaggcactgattgatgcgaaaaaatggggcctgatccgatccatcggcgtctgcaatttcctgcctgagcacatcgaacggctcgaacgtgaaaccggtgtaaagccaggcatcaaccaaattgaactgcatcccgcttttaatcagcagcagcagcgccaatggcacgaagaacagggcatcgtgacagaatcatggagtccgttatcccgcgccggcgaagtattgaacgatcaaaaactcggacagattgcggacaaatacggcaaaaccatttctcaagtcattttgcgctggcatatccagctgggcgccatcccgattccaaaatcagcatcgcccgagcgccagcttgaaaacatctctgtttttgatttctcccttgatgaaaacgacatgagcatcatcgactcgcttacccgccccgacggacggataaacggccaagacccggcggagtatgaggagttttaaaaaaacacataaagaaaagctgacggcatcatttgtcagctttttcaccttttactctgggatagccaagactgtgaaactttgcagtaaaggctggaaacacacttatcctattataaattgatcagctgctaaaattcttttttatgatatatagctgcggcgatgaaaaatgaaatgatatataagataacgccgatcatgagatatataatcgggacatataaagaaggatttatgtgcaaaaatgacagcggtacttgttctgctgcatacccaacgacactttgcaatccaaaggtagcaaaaagtccccccattgcccctccaatcacgatagcatcggatttttccgggcctatcatgtagagaagaggataaacgattgcaccggcaaagagaacgatgaacgttccaaaagagacaatattaaatataccgtcaattggttcatcagaacccaggctgtatacaaggaaaataccataagatattacagctccgatcacaacaatcaaaagataaaagaaatagtgactttgaacaatatttgttctgctgaccggtaaagtcagaacatacctgtcatagcctgacttgctctcatactttataacctcaagtgcgggcataacgacaaacaaaataatcagcatagcaacaaaacgatgcattgaagcatccccaaaataaaaaatgactgctgataccaatatggccaaccccgtgtatgcaaagaaactccgataaaccaagtaatagttagtcagtaacagacctctcaatgttttcactcctcgttaaaaagacgctgatttcttctatggaaatggtgttggccgttacgccattcggcaatttctgttgatccgatacaagcacactccaataagatccatgattcctttttgctagaacgatatcttcgtcaatctcagccaattgaccttcatcaacgtctataacggtatagctttcaagaaccttatctttctcttcatttaataaaatttcgccatctttcatcataatgatatggctggctatcttctcgacatcagtcataatgtgcgatgaaagtaaaatacctccgttgcttttactcacaaagctttttaattcatttaacagatcatctcttgaagagggatcaagccctcccgttgcttcatccagaagtaataattttgcattatgcgacaaagcaacagctacagataacttcattgacatgccgcgcgagaatgtattcacttttttatccataggtaaagagaaagaatgaaccaaccggtaaaattgatcttggtcccaagcgtcgaacagtttcttaaatacatgattcagctgctttatcgtaaggtgcgcgggaagattcatcgcatcaaatacgaccccaatatcttctttaaactttatatgtttatccagattctctttaccaaagattttcactttacctctatcctgagagattaatcctaatatcgttttaaatgttgttgacttgcctgcgccgttatcaccgataaaaccgacaattgatccggcaggcacattgaatgtaacatcctttaaaacagctttatgaccaaaagatttgctgatgtttctgatttctaaaaggtttgacatcattccactcctatcattgttgtcaggacttttttaagaattgaaccggattattgtaaaaatgttgtgattttcatatctggtctaggtattcataatggatcaggagtcgggaaatacaaaagggattttaaagtcttaagcataatatggaagtgtaatcgattgattaggtttatataatgggatattcatgatgaaaactgctgaggtgtttactttccgatgaggtatacacaaaatgatttactaatgattacatttatggattttaaccggaatgcatctcgtattataaagcaggtgttactccttttcaatatataaaaggggatttctttacaatcgcaaagagtatgcatttctcatttccgcattaaaaaacccctctggctaataaccaaaggggttaaatatattattccacagtcacgctcttcgcaaggttgcgcggtttatcaacgtcacagccgcggtgcagtgccgcatagtaagcgatcagctgcaatggcacaacagaaaccagcggagcaagcgcagggttgacttccggcaggatgaatctgtcgtctgcgtcttctaagcctttcagcgagatgatgcaagtgttggcgccgcgggccgcgacttccttcacgtttccgcggatgctcaggttgacgtgttcttgtgtcgcaagcgcaaagaccggtgttccttcttcaatcagagcgattgttccatgcttcagctcgccgccggcgaagccttccgcctggatgtaagaaatctctttcagcttcagggcgccttcgacacacacgaagtagtcaaggccgcggccgatgaagaaagcgtttcttgaaacagtcaggtactcacgcgcgatcatttccatttcgtccttctggtcgcagagggcttccatggcgtttgccgcaatacctaattctttgaccaaatcaaaaccgatatcaacgccgttgcgttctgctgcaacggacgcaacgatcgcgaggacggcaatctgagccgtatacgcttttgttgatgcaaccgcgatctcaggacctgcgtgcagaagcaatgtgtaatccgcttcacgggaaagcgttgatcccggaacgtttgtaatcgtcagcgctttgtgacccagcgctttgacttgaacaagcacggcgcggctgtccgctgtttctccgctttgagaaaggaagataaagagcggcttcttagacagaagcggcatgttgtaagagaattcactcgctacatgcacttcaaccggtacgtttgcccacatttcaatatattgtttcccgacaagaccggcgtgatagctcgttccgcaagccacgatataaatgcggtccgcttccgccacggcgtcagcgacatcgcccgccacggccagtctgccgttttcgtcctgatacgtttggatgattttgcgcataacaagcggctgctcatccgtttcttttaacatgtagtgagggtatgtgcctttttcgatatcactggcgtcaagctcagcgatataagacgcacgtgtcatgacttcaccgtcaagatttttaatcacggcttcgtcttttgtcacgatcaccatttctttgtccaaaagctcaacgtattcattcgttacttgaagcatagccatcgcgtcagatgccacgacgttaaacgtatctccaaggccgattaacagagggcttttgttttttgcaacgtaaatggtgtctgtgttttcaccgtcaaataatgcaattgcgtaagagccttttaacagagtcagtgttttgcggaacgcttcttctgtgctgagtcctcccgccacaaattgctcgatcatttgaacgactacttcagtgtccgtgtcgcttttcagttcaacgttttcaagatactcgcgcttcagctgaacatagttctcgatcacaccgttatgaacaagtgtaaagcggccgagtgcgctttgatgcgggtgagcgttcaggaagcttggttcgccgtgagtcgcccagcgtgtatggccgattcccgcttgagattcaaccgtgtggtccaccacttcacgaaggtcggcgatgcggcctttttctttgtacacatgcacgccctgctcattcgccacagcgataccggcagagtcatagccgcggtactcaagcttctctaatccttttaacaaaatctctttcgcatcaagctgaccgatgtaacctacaattccacacatattttcttcctcctaaaggtgtaaaaggagacgaagaaagtcaaattacaaggggactttcaatcgtcccctcccacatgtttttttggaagatcatgtgatttccctttgttcggagagtcgcccctccggtttgaagaaatccttacggctgtgatctaaatgaatcagccgggaggcatccgccgaaaattcgataacctccatcctcgtcaactaagccgtttttcgggcgcttagttcgggcgctgtaattataaaagatgcaaacaatcccgcctttcctgcaagtgaaaaacaaaggctgaacaagcttgattttacagcatgtgccaaggacggtcaattattttttgccgccccggcatcatgtttactatcattttatgctgatcgcacttgtcttgttcgctctctgcttataaacttcgctactccgctcccatttctgtccgcacgacatccacgatttttgtgacatattcgtcacaaagctcttttgttctcgcttccgccatcacgcgtacgagcggttcggtgcctgacgggcgcactaaaatccggccgtctccgttcatttctttttccacttcagaaatcacggccttcaccttagcgttttcttctaccttatatttatccgtcactttcacgttcactaagagctgcgggaattttttcatttcatccgcaagttctgaaagggttttgccggacgccttcagcgtattcacaagcatgatcgcggacaaaagaccgtcgccggtagtgttgtaatcaaggaaaataaggtgccctgactgctcgccgccgacattatagccgtcttttttcatcgcttctacgacatagcgatcgccgactgccgtttgaacgcttttgatttcttctttttcaagcgctttgtagaaaccgaggttgctcatcacggtcgatacgacggtatcatccttcagacggccttctgatttcaaatacttcgcgcatatgtacatgatctgatcgccgtcgacgatgtttcctttttcatcaacggcaatgaggcggtcgccgtctccgtcaaacgcaaggccgatatcggcgtttttttctttgacgaaagcactcagcgcttccgggtgtgtagaaccgacgccatcattaatgtttaatccgttcggagacgtccccattgtagatacgtcagcatcgagatcggcaaaaaggtgcgtcgcaatggaagatgtcgcaccatgggcgcagtcaagcgctacatgaatgcctgtaaaatcttcgtccgccgtctgttttaaaaattgcagatacttttgaacgccttcaaaataatcgttcacaagcccgaggtccgcgcctgtcggtctcggcagcttatcttccggttcctccatgagacgttcaatctcggcctcctgctcatcagaaagcttaaagccgtcccctccgaaaaatttaattccgttatcctgtacggggttgtgagaagcggagatcatgacgcccgcctcagcatccatggctttcgttaaataggatacccccggcgtagaaataacgccgaggcgcatcacttcagctccgatcgataaaagtccggcgacaagggctccctccagcatatgtccggagatacgtgtatcacggccgatcagcactttcgggcgctgcttatctttggtcaggacataaccgccaaaacgccccactttaaaggccagctctggcgtaagctcgctgttggcaacacctcttacaccatctgttccaaaatacttgcccattttgtatcgctcctttttcattctgttgaagaagaatcagcgcttgatccgtcttcatcctggtcttgattttgatcctggttttgacttttattctgatcgctgtcagtgtcgtcttcccggttcttgttcttgtctttgtctgcgtctccgcttgtgccgttcttattgccggaatcagcggagccgccgtcatttttatttgaacttgtgtttttcttagaagtcagcttgatcttaaccgtgtcttttgacagggaccatgtgacgttttgcgggccgtttacttcaagctttacagagtgctctccgtcatccaagtccgagacattggcatacagttcaatgtccgactttttcagcgccttaatgttggcgggagagcctttggccgtaatatttatcgcctgcgattcagggtcgagaaactcaatctgctgtgagcctcccagtccgaccgtcttgattgcgacattgtcaaaatcctttttgtcttcactgtccactttaacatgaagcgtgattttttccggtgataccttagtgacacccttaggaagcgggatatcggcattgatatcggtatctttatcaattttgcctaaatcaagagatacgccgtcaataaattcaagtgaatccagcacatcctgcgggccgtaaaccgtcacctcactcggattcgagtcaatgctcgcaacgctcaccccgtccggaagacttcccttcctttcgattttgaaaggaagctttttgctcggactggctacgggaaccgtcactttaatgactgacggttcaacatcaacaggaagtgcgttgccgtctttgtcatagacggtcaccttcacttccttttcaatggtctcatttgcattttcaaggttcacagatgctttgacaagtgaaatgttatcaatcacatttttcgaacctgtaatctgcacgtttttcgggctgataatcggctgctgaggggtatatccctttttcattttgcttttattgtagtattcaacttccacgggaaaactctcagccgttttttcctgaatcgtaaccgtcgtgactgacgggtttatggagatcgtcagtccgtccgatacgtttttcgccttcaattcgaccttatgagtcccggtcttcagcttattcatatcggcgtatatctcaaaattcttcgtctgtctcgcctttttcaccgcgcttgtcgagcctttaatcgtgacatttaccgtctggggcacgccggtgacgacatagttcgcttcatcgtagtatgcttttacaggaatatcagtaagcgtagcctcgtcagtcgttgatgtcggaaaaaaggattcccccggctttttcggagtcggcgcctggttgttgttaaccgcaacgtaaagcagcagcgccaagagcaatgcaatgatctttacagcccagcggttgtttaagaatttatccatttttcttgcccctccagtaccagcggttagaagaagtgtctctggcgttcttcttaaactcggcttcaagcatttctttcagtgcttcttccgtcaattctctgtgaaggtctccgtttctggccacactgatggcgcccgtctcttcagatacaataatggttaagctgtccgtcacttcactgatgccgacagccgctctgtgacgcgtccccagctcctttgaaataaacgggctttcagaaagcggcagataacaggcagccgcagcaatctcgttatttttcataatgaccgctccatcatgcagcggtgtattcgggatgaagatattaatcaaaagctccgagctgacctgcgcattaagcgggatgcccgtctcaatataatcgcccattcccgtatcgcgctcaatggcgatgagtgcgccgatgcggcgtttcgccatgtagctgatcgattttgtaatcgcttcaattgtcttatgctgcgcttcctccacaggggttccgctcctggaaaagaaccggccccgtccgagctgttcaagcgcccgtctcagctcaggctggaatataatgatgatcgctaaaaatccccatgttatcgcttggtccatcagccactgaagcgtgctgagtcccaaatatgaactggccatccggaccaatacgatgacgacgattccttttaaaagctgaaccgccttcgtcccgcgtatgaccatgattaatttatatatcacataccaaacaaggagaatatcaacggcattgccgaggtattgcaaaaatgggatgtcctcaaaagccatttcctcgtcctccaagaattcagtcatttcgttttttccgttatgaattgtgctgcatgagcaatatgtacatcatatagcgtgctcattataccacattttgatttctcaagtgaaatgagccggcgcggcgttgcacaaaaaaagagtaaagcgattatacgctttactcatcttcattcgggtccaaagcgcttacgacgccctgtcccgccgatttcagttcgtaccagacccagtcaaacaattggttaatctcttcaatctgcccggtgacttgtccggctgaggccatgtatttttctccgttgacgacggtcacattgccgtcgacttttccttcaatgaacagcttgccgttttttactgtgacatcgccctttacggtctcgccttcagggacggtgaccgtgtgattctgcacgacaaggttcggctgtttggacacactgaaattgtggtcattatgccagctgttgaaaaaaccgccgcccattaaaatcacaaaaaccgctgcggctgcaatcatcggatgagttttgatccatcgttttacagaagcgcgttttttctcttttggaagattcgccataactttggcagtaaaatcagcaggggccgtgacatgcgatgtgcttcggacgagtgctacggatttctccatttcatgaaaatgccgtttgcaattcccgcatgactgcaaatgttgttttaatacgttttcatcttcaggaaggatatctccatcaagatgcttatgcataagctgcacaatctgttcaggacagctcatttcatcaccccacttaaagatccctcaattgttttctaagagcctctctgcctctgtgtatccttgtcttgacggtgccgacagggatattcagaatctccccgatttcaattaaagagagttcgtcaatatactttaatacaataaccgttctgtacttgtcaggcagctttaaaatctttttctgaattgtgtccgacagctccaatgacaatacggcgtcttcagggagaaccccgtccgcggcgatctgcgaatacatcgtcagcccttctgctcccgctacttctgcgtccagatagtaatcaggctttttcttgcggatgcggtcaatggtcaggttggtcgcaattctgtaaagccacgttgaaaactttctgttgatatcgaaactgtcgatattgacatacgctctgataaaagcttcctgcgcaatatcttccgcttcgtgaacattgccgagcatgcggtagcaaagctggtaaatcttatctttataaaggtcaacgatttctgcaaacgcattttgatcgccttttttgacttgcttgattctttttttaatcaggttttccatgttttatcttacctctgcccttcaccggtctgtatctatacgttgattgttttaaaaggtttcatttttttattacatttattttaccaaatttcaggcagggtgtagatggaaaatacagaatatactgccttaacagcagcttaaaaatagtatatctgatgaacaatcaaaaaccgaaacaaaatgccgataaaaaaagacacctttatgcaaaaggtgtctgagactgggctagctggattcgaaccaacgcatgacggagtcaaagtccgttgccttaccgcttggctatagcccaaaaatggtggagggggcagattcgaactgccgaaccctgagggagcggatttacagtccgccgcgtttagccacttcgctacccctccgtatttttttggaaaacagtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatgacccgtacgggattcgaacccgtgttaccgccgtgaaagggcggtgtcttaaccgcttgaccaacgggccgctgtgtccgcgtcgagctgacaaaagttattatatacaggttgtaccccatttgtaaagagaaaaattattttttttattttcaaacttttttacccgttttttaactgaaaaactcatccctcctctcttatttcatttatgatgaaagtatcaaaatattgaagggaatggacacagatgatcttagtcagctcttgtctcggcggtatcgaatgcagatataacggctctcacgccgcttcggaaaaaatccgcagactcgtagaagaaaagaaagctgttatggtctgccccgaacttttgggcggcttcaccactccccgcgaaccggcggaaatcatcggcggcacgggtgaagacgtgctgaacggaacggcaagaatcgtaacggcatcaggcgaagacgttacagctttatatatggacggcgcggaaaaaacgttagcatacgcaaaagaaataggcgccgcaacggtcatccttaaagaaaacagtccgtcctgcggcagcagctttatctatgacggcactttctcaggaaaaaaaatactcggagacggcatcacttccgctcttttaaaacgggcaggctgccgtgttctatcagaagatgaattggatcaattataaaaaaggagagtagatatcatggatgtagccctgtccttttataaaccggagcatgcagacgggctgaacgggtttgtgctgagtgaagaagataaaaagttcacagctctgccgatagatgtcctgccgcaggcgcttgtcatccgggatcgctacccgacagtcattttaaaagaagaccgccccgtcggtttttttattttacatacctcaaaagaaaccattgctccgtattcgaacaatgtgtctgccattttgctgagtgcgctgtcattacatgcgccgcatcagggaaaaggttatgccaaacaagcgatgctgcagctccccgcttttgtcgcaaattactttccttggtgtgatgaaatcgtgcttgctgtaaaccatcgcaatcaacgtgcaaagaacctgtaccggtcttccggttttattgacaaagggcggcgcaggatcggcccgatcggtgaacagcacattctgcatcattttttgtgaaagcgcttgattattcatctcatccctgccgatttttcttgaaacatctattcagaagcccatatacttcaagtattaacgacttgggagggtacaatcatgacagaccggcttaacattcacagattgaccacagaaaccagaaatccgcagaccgcttcaatccatcaggcagacacaatggaaattctccgcatcattaacgaagaggatttcaaagtggctgaagccgttcagcaggtgctgcccgatattcagattgccgttcaattcgcccatcagtccttacggcgaaacggcaggctgatttatgcgggagcgggcacaagcggcagactcggtgtactggatgcggttgaatgcccgcctacatacagcgtaagtcccgacaccgtcatcggtctgatggccggaggggcagacgcctttttgcaagcggctgaaggtatagaagacagcgaggaaaccggcgctctcgatctcaaaacgatcgggcttaccgcagaagacaccgtgatcgccatcgcggcaagcgggcgcacgccgtatgcggccggtgcgctgaaatatgcaaaaacaatcggcgccaaaaccgtcgcgctcacatgcaataaggactccttgatcagcacctttgccgatcacagcatcgaagtcattgtcggccccgaagtgattacagggtcaacacgaatgaaagccgcgacggcacataaaatgattctgaacatgatttccacggccgtgatgattaaaagcggcaaagtgtacgaaaatttaatggtggacgttcatgtcagcaacgaaaaattgaaagaacgcgcaatcggcattatccaaagcatcacgggcgttccgtacgacaaggcaaaagaaacgcttgaggccgcagacagccatgtcaaaacggcaatcgtcatgctgaagacgaattcggacgaaacacacgcgaaggcactgctcaaagaatcagaaggattcattgataaagccattgaacagcacgtttcaagagaaaaagaacgctgatcgttctttggagaaaaatattgtgcttttacgagcccgcgccgttttcatgttcggcgcaggcgcttttaggacgcgtttcaggcatagctccccgggaaaaatcgtacagaaaaaggaggatctccatgagcaaagaggcattttatcagtcactggccaaagatatcctggacaattgcggcggttcatcgaatatttcaggctttacccactgtatgacacgcctgaggattacacctttagatcgggacaaaacggatattgaggcgctgaaacggcttgacggggtaataggcgtcgtcgaagccgaaacactgcagatcattctcggcacgggtgtcgtcaatcatgtcgccgacgctttcgcaaaacttatgccatccggaaaaaacattgatttaaaagaagccgcctcacggaaaaaagccgatctcaacagaaaaaacaccacacccatcaaattgtttctgagaaaaatatcaagcatcttcattccccttattcctgcactcattgcatcaggtttaatcaccggtattacgaaagccgtcattcaggccggctggctcccgaaagaatcccaaatcgcacttattttaacggttatcggttcaggcttgttcgcttacctcggcgtccttgtcggcatcaatgcggcgaaggaattcggcgggacacccgcgatgggcggccttgcgggcatattgatccttaaccctgagatcgccaatatcagtttgttcggagagaatctgctccctggcaggggaggattaatcggcgttcttttcgctgcggtttttatcgcttataccgaacggtttatcagaaagtacgtccatcaatccatcgacattatcgtcacgcctacattgtctttacttatcaccgggctggtgacatatgtcgtttttatccctgcaggcggttttatttctgatctgattacatcaggtttattgtcgctgctgaatgtcgggggagtgctctcagggtttgtactgggagccgccttcctgcctcttgtcgtcaccggcctgcatcagggcttgactcccgtacatttggaattaatccgatcaatcggagatgacccgcttcttccgattctcgcgatgggaggcgcgggtcaagtaggcgcggccttcgccatctttatgaaaacaaaaaaagcctcattaaaaagagcgatcggcggcggacttccatccggtctgctcggaatcggagagccgcttatcttcggcgtcacgctcccgctcggccggccgtttttgacggcgtgtttaggggcgggaatcggcggcgcctttcaagcccattttcaagtggcgactttttcaatcggtgtctccggccttccgctctcgtttctcgtacagccggctcaaatcgttttgtatatcatcggtctcttcatctcttacgcggcaggctttgtcttcacttatgcgttcggatttaaggatgacatggctgctgaatttgaataaaccgggagggatcagaatatgaaaacactgacagccgccatactcacaatggtcatcagcctctcttttctgccgcagcacaaagccgaagcccaatccaaattatacgacgcagcaaagctcagaaaggttgatcaaatgattgaaaaagacatcgcagcaggattccccggagccgtcctcatcgtcgtaaaggacggacgggtgatcaaaaagaaagcatacggctacagcaaaaaatatgacgggaacacccttttatcccgtccgaaaaaaatgaaaacatcaaccatgtttgatttagcttccaatacaaaaatgtacgcggccaattttgcactacagcgactcgtcagccagggaaagcttgatgtgtatcaaaaagtctcggcttaccttcctgatttcaaagacagaaaaagcgatccgattcaagaaaaagaccgtatacgcgtcatcgatgtgctccagcatcaatccggtctgccggcaagcttttatttctatcagccggacaccgcaggccctttatattcacaagaacgggataaaacaatccgttttctcacccagatcccgcttgaatacaagccgggaacaaaacacgtatacagcgatatcggttacatgattctcggatgcatcattgaaaacataaccggaaaaacccttgatacctatgcggaacaagaactgtacaaaccgctgaaactgacgcacacactgttcaatccgctgcaaaaaggttttaaagaaaaagcattcgcagctactgaacgtttaggcaacacacgtgacggagtcatccatttccctcacatcaggacatatacgctgcagggggaagttcacgatgaaaaagcattttactcaatgggaggggtgtccggtcacgccgggctgttttccagagctgatgatatggccgtccttcttcaagtcatgctgaacagaggcagttataaacacgtttctctcttcaataaaagaacggccgatttgttcacaacggcggcatcctctgatccgactttcgctctcggctggcggaaaaacggcagcccggatatggagtggatgttcggaccttatgcaagcaggcaggcatacggccatacgggatggaccggcaccatcacgattattgatcccgcttataagctggggatcgcacttttgaccaataaaaagcattcccccgtcgtcagccccggtgaaaacccgaatgtttttgaaggggatcttttcccgaccggaagctacggcagcgtcataaaagcgatttatgaagccattgaatgacaacccatgtcttttgtccaaactatgacggcaggagggcaccatcatgaaacttttcatctcagctgtattactgttgttcattgtattcggcacgcatcatgcatcaacaaaaccggacattccgtcacaggcggaacaagcggtatcccgtatgacgttagatgaaaaattagggcagatgctcatgcctgattttcgaaattggcaaaaaaaggggcagtcatcacctgaggctcttacccaaatgaatgacgaagtcgcagggcttattcaaaagtaccggttcggcggcgttatcttatttgcagaaaatgtaaaaaacactgagcaaacggtacgcctgacagatgcctttcaaaaggcgagccctgacattccgctattattaagcattgatcaggagggcggcatcgtaactagacttggtgagggcactcatttcccaggcaatatggcgctcggggctgctagaaaaacagcctacgcgtcccagaccggcgccattatcgggaaagaactgaaagcactgggcattaatacgaatttcgcgcccgttctcgatatcaataataatcccggaaaccctgtcatcggcgtcaggtcgttcagttcagaccgtgatctgacagcttccctcggccttgcctcaatgaaggctcagcaaaagcagaatgtcgctgccgccgtcaaacatttcccgggacacggcgacacggatgtcgacagccactacggtcttccgcttgtcacccacaatcaagaaaggctgcgtcagattgaactttatccgtttcggcaggccattcaggccggagctgatatgatcatgacagctcatgtgcaatttcccgcttttgacgatacaacctataaaagcaagctggacggttcagacatcctcgtacccgccacactctcgaaaaaagtgatgactcatcttctccgtgaggaaatgggatttaacggcgtcatcgttacggatgcattaaatatgaaagccattgccgatcatttcggtcaggaagaggcggtcgtcatggcagtaaaagcaggagtcgatattgccctgatgccggcccaagtgacatcgctgcaaacggaaaaccgctttgcccgggttcattccgcgttaaaaaaggcggtacaaaaaggggatattccgctgcagcaaattaacaaatcagcggaacgcatcatttccctgaaaataaaacgagggatatatcccgcaccgaaagagacaaatctgaaaaagaagattgcaaaagcaaagaaaaccgtcggcagcaaaaatcacctgaaagctgaaaaacaaatcgcggaaagatccgtcaccgtcttacaaaacaaaaaccgcacgctcccattcaaaccgaaaaagaacagccgcgttctcattgccgctccttatgaagatcaaacagcggcaatggaacaaaccattcggcagctcatcaagaagaaaaaaatccggccggtaaccatcagtaaaatgaacttcgccgagcgcacatttcatgatgaacacaaaaagctggtatccgacgcggattacgtgattacaggctcctatgtcgtaaaaaatgaccctgtcgtaaacgacggcgtgattgacgattccgtcacagatcccggcaagtggacgaccgcatttccgcgggccgtcatgaaagccgcacaatcgaaccaaaaaccctttgtgctgatgagcctgcgtaatccttacgacgccgcgaattttgaagaagctgaagcccttatcgcagtctacggctttaaaggatatacagacggacaattcctccagccaaacattccggcaggcattgaagcgatattcggacagacaacaccgcaaggcaggctgcccgctgacattccttcagtcacgcatccgggaacgacactgtatccttatggtttcggtatcaatctgaagaccggaaaaccgctttaaacaggagggctgattatgaaaacacatacggctgcacttctcgccggacttgtcgtcatcagtgctatgacggcagtctcggcggcttctgacagaaaccttcataccgccaagaaaccaagcatccaaacaggcatcgaccgcctgctgaaagattataaacaggaactgaagggaaaaagggtcgggctgatcaccaacccgaccggtgtgaacgcatcattgaaaagcagcgttgacgtgctgtatgaggcgccagacatccgcctgacggcattattcggaccggagcacggtgtccgcggcgatgctcaggccggagacaaagtcacatcctatatagacgaaaaaacagggcttcccgtctacagcctatacggggagacgaggaaaccgacgcctgacatgctgaaagatacagatgtgctgattttcgatattcaggatgtcggaacccggtactacacctacatttatacaatggcctatgccatggaagcggccaaagaaaaaggcattcctttttatgtcttggaccggccgaatccgcaaggcggacgaaatccggacggcccggttcttgaaccggattacgcttcatttgtcggactgtatccgatcccgctgaagcacggcatgacgatcggtgagcttgctcttttattcaataaagagtttcatattggcgctgacctcaccgtcgtaaaaatgaagcgctggaagcggacgatgacgattgaagataccggtctgccgttcgtcctcccttcgcctaatatcccgaccccggacagcatatttgcatattcggcaacaggactaatcgaaggcacaaacgtatccgaaggaaggggcacgacaaagccgtttgaacttatcggcgcgccttatatgaaaagcaccgagctcgaagaacgcctgaacagtctcaagctttcgggcgtcaccttcagagccgcttcattcatccccagcttctccaaacaccagggcaagctgtgccacggcgtacaagtctacgtaacaaacagaaacacatttgaagcggcaaaaacagggctctccattctgaaaaccatgcatgacttatatccgaatgacttttcattcttgccgacaggctcttttgacaagctgatcggtaacggctgggtacgcaaaaaaatagaaaaaggcgcttccattgaagacatcaccggcacatatcaacgccggctggaccaattcaaaactctaagaaaacaatacctcatatactgacaacattcgtgttacacgtgtaacattttgacgcatttcacatttccgctttttataggaaaacattcatttatttggtacaatttaaatgataactgttatcatttaaatgaatgtttcctaaaaggtggtttctcatgaaaaacacattattctttcagcccattgatatcatctccgtgaaaaaaacagccgaccttctgtcagagcatcagctcactgattcccccgtattgatctttcatgtgaaaggcgagggacaaattgatatcggaacagacagctttccgctgcagaaggaaacgctctacatctgtccttgtgatgagacattcaatattgcccctatatcgtcaggcggcatccatttgtatatcgtcagactccgtgttttctcctattcctcagatgatgaagcgatgcttccggataacggggaagacatcttccacggacttcagcaaatgaatttacaaacggttgatcatttgacaagccggcttcaatcactttctgaaaacgtgcgatcggcggatggattgcagaaaatgaaatataccgccgactttcagcagctgatgtacgacctttatgccgcaaaagtatgccatcaaaataatacgaaagcggcgatcgaacagacaaaacaattcatacatgctcagtccgacacaaaaatcacgctcacccagctcgctcatatggcgggaatcagtcccaagcattacagtgaaacctttaaaaaactatacgggcagagcgtaactgaatatatcacagacatccgcataaccaatgcgaaaaaactgatggccaaggcaagctgcaaactgcgggaaatcgctcatcaaatcggctaccaggacgaattttatttcagccgcatctttaaaaaacataccggcagctcacctacaagctacatgaaaaaaaggcgcacaaaaatggccgcgtacggaaaagaaacgatggggcatctgattcctctgcatcacgtgccttacgctgcggcgctgcacccgaaatggacggcctattattacaaacaattctcttccgatattccggtccacctgagcgcttaccgctataatgcaaattgggaagagaacctgcatacgctgtctcaagctgccccggacattattttcagtctcgattctgtcagtgaagaagaaaaacagcgcctgaatgacatcactgaagttttttatcttccggctcaagagaattggagagaccagtttcttcgcacagccgcatatctgaatgaagagcaggaagcgcggcactggcttaaaacttatcaaagtctcacccattcagcgaaagatgctcttaaacatgtgcggcaccagcggttcttatttgtccgtgtatataaagaaaatatgtacatcgcccataacaacagtattgaggaagtcttcttcggtgatttggactttgcctccgcaaaaccggaatcatttgctcctgacgaaaagatttccttggaaatgctggcggattgccaggctgactgcatcatgcttttcacttgtaaagaaccggaaacgcttcgctattttcagcggattcagcagtccgggatatggcagaaccttagtgccgtcagcaataaacgcgtgtttcccatttcatctgacccgtggattgaatattctccaagcggacatcagcggatgatcgagcaaagcatttccattttatccgaagatcgtccatggtaatgccggaaattatccatggtcttatccctattcattctctataattccaattgataatagttatcaattgaacaggaggaacaatagatgaagaaattggcattcgctttcatgattttgcttttggctttcacggccgcggcttgcggaagctcagaaacaactgatacagcaagtaaaggaaaggacgcttcttcagataaaaagaaaatcgaatatctcggaaaaacatatgaagtcaaagcgccgactgacaaaatcgccattacaggcagcgtagaatcaatggaagacgccaaattgcttgacgttcatccggcaggagcaatttctttctccggcaaattcccggaactgtttaaagatattacagataaatccgtatcaacgggggaaaaaatgcagccgaatatggaaaaaattcttgagctgcagccggacgtcattctggcatcaaccaaattcccggaaaaaacgttgaaaaaattgagcggcaccgctgaaacgatccctgtctctcatatctcatcaaactggaaagaaaacatgatgctgctcgcccagcttacagataaagagaaaaaagcgaaaaaaatcatcgcagattacgaacaggacctgaaaaagacaaaaacaaagatcaacagcaaagcgaaacagtcaaacgcgctggtcatcagaatcagacaaggcaatatttatatttatcctgaacaagtttatttcaactccacgctttacggtgatttaggcctgaaggcgccggacgaagtcaaagcggcgaaagcgcaggaactgatttctcttgaaaaattaagcgaaatgaaccctgaccatatcttcgtacaattttctgatgacgaaaacgcagataagcctgacgctttgaaagacttagagaaaaatccgatctggaagagcctgaaggcagtcaaaaaagaccatgtatacgtcaatacgattgatccattagcccaaggcggaaccgcgtggagtaaaatcagcttcttacaggttgcggctgacaaattgactcaagactaataaagagtaggtttttcacatgtatgcaaaacggcggacacacattattatcattgcttcaccgattgctattgttctgtcactgctcctttccgttttatacggcgcaaagcagcttgacatccataccgtgttctccgcattgctgcactttaatccggagaataccgaccatcagatcatatggcattcaagaatcccgagggctgccggtgctatgtttatcggcgccgcccttgctgtttccggagcgctcatgcagggaatcacacggaactatctggcctcgccttcgatcatgggtgtgtcggacggctccgcttttatcatcaccctttgcatggtattgctccctcaatcgacatccattgaaatgatcatctactcgtttatcggttccgcattcggcgccgctcttgttttcgggctggcctccattcttcccggcggttttaccccggtgcagcttgccattatcggaacggtgaccagtatgcttctcagcagtctgtcggctgcgctttcgatttattttcaaatttcgcaggatctcagtttttggtacagtgcgagactgcatcaaatgaaccctgattttttgaaactggccgtcccgttttttgcgatcggaatcattacggccatgattctcagcaaaaaggtcactgccgtatcattaggagacgacatttcaaaaagtctgggacagcagaaaagaaccatcaaactcatggcgatggcggctgttgtcatattgaccggaagctcggtggcgctcgccggaaaaattgcctttgtcggtttagtcgttccgcacatcacacgttttctcgtcggatcggactacagcaggctgatcccatgcgcgtgcattatcggcggcgtctttctgaccctttgcgaccttgcgagccgattcatcaattatccgtttgaaacgcctattgaagttgtcacttctatcatcggtgttcctttctttctttatttgattaaaagaaaaggaggggatcagcgtggtgcgtaaaatggcaggaatttatatcattctgattgctctcatattgctcgtaagctatttcagcatgacaagcggttctttttccgcaaagccgggtgaactgctcagtacgcttttccgcatccatccgaatccgcaatatgacattttgctgtttcagctgaggctgccgcgcatagtcatggctgctgccatcggactcggattggggatagccggagctgttattcaggccattaccaaaaacggtcttgccgatcccggtattttgggcattaatgcaggagccggagcgggaatcgtcacgtttatgcttctgtttcagggacaatctgaagcgacggcacttgcctctgcgatgggtatgcctgtcttcggcctcatcggaggactgatggcggccgtgctgatctatattttcgcctggcaccgggggcatctggaatcgggcagaattattctcgtcgggatcgccatgaattccggattcagcgcgctgtctttatttctatcattaaaaatggacccgcaggattatgagatggcgatggtttggaaaaacggcagcatctggtcggcaaactggatgaccattacggcaatccttccgtggctgatcttgttcattcctcttcttatggcgaaaacgtcattgcttgataccattcgtttcgatgaggacacggtgaaaagcctcggtgtttcaaccaataaagaaaaaaccattttgctcattgcctgcatcgctttgatcagcgcatgtgtaaccgcagcgggcagcatggcatttgtcggactgatcgcgccccatatttcccgcaggctcgccgggattgagcacagatactcattaccggtcagcggactggtcggtatgctcctcgtcatatccgccgactttgcgggcaaattgttctttcagccttcagaagtgccggcgggaattatccttgcaattctcggcgttccttatttcttttttcttctgtttaagcaaaaaaaggggatggacgcatgagaggcacccttacagaacacccgataaacggaagggaatgcactgtgtatcttcctccttcctattcggttcaaacaggggctttaccctgtgtgtacgtacttgacgggggttctttgtttttagaacagatagataagcttgaatcccaatttacgaacggaacacttcccgaattgattttcatcggcatcaaaccggctgacagactcgatgagtacacaccgtggcccgcgccttccctgagccctgcgtttcatgatttcggcggcaaagggaggctctttctcgaggagctgacaaatgtcattattcccactgttgaagatacgcatcacatttctgcgcatccggaaacgagaggactgatcggtgcgtcattaggcggactgttttcgatatacgcgatgctgcaaaagcctgaaatattcggcagaatcggctgtatttccggttccttctggtatgaaaaatcagcagattatgtccgctccgcacctttgcggccggcacggcagcgtatctttatgtctgtcggcagccgtgaagcagagcaaaaatgtaacatccaaaacaccatgatcggacaaaataaagacgtgtacaaaagcctgaggcaaaaaggcttttctcaatctcagctctcattcacgatcgaagagggcgccgtgcaccatcaagaagcgttcaaacgacaatttaattcagcactaagctggctgtacggaaaaaaccgctcacgtgactgagcggtttttttcatacttgatcacgaccggcttaagctcaaagcgtctcagcaaatagccgaacaaagcggcaaggatttgctgaaagagcatcccgatgacgaccggaaccgccacttgagacggaaagaaagacacggcgagaacggctccggcgctgatattgcgcatgccccccgtataaatcagagacacgatttcatcctggctccgcttcatcagtcttccgatcagccaagccacggcataacccgtcatggcaataaaaaataccgtgcctgcgatgcccgcaaatttgatatccacgtgcgtgacatacggcgcgatttccgaactgttaatggcaatgacaatcatcagacagatttttgaaaaaggagacagtgaccggcttatcgcctgagtccttaccggcggggaaaactggttgaccatcatccctgcgatggacggaatcaccaccatctccgccagccctttcatcatgccccacacatccatctgaacattcgccccggccaggacagacaggcttaatggtacgataaaaggagaaagtacggtatcaaccaggataatagacagcgtcaatccgacatttcccttatacatcgcagcccaaatcaaactcgtaattccggtcggaatcaccacacccataatcagccccgtcacagttaaagggtcaccgctgaaaatcagatggccgcttccccatgcaaaaacaggcatgaaaatatgcagaacaaacaatgccatgatcatcgggagcggcttctcgatactgcgcttcagcgattgaaaattggcactcagactgcccgtaaatgtaataaatgcaaatatccacggcacagcgccggccatccagctgatatgctgagataacagcacacccgccgccacactagacggagtcaaaagcggcatgattctccccaacacttggttcaacttctgaagccacatcatatgcaagtctcctatatacggttttcaagtctcattcattataacaatgcacaccggcaaatttaaccgaaaaaaagcccggatatattcatccggacttcacaaattctatgccatttgtttcattaaatctcggcttttctgatttaatccctttaattcagcctcaattccgtattctttacatttggcgacaatcttctcaagagcagccgctccagaatcatcccacacgtgggcatcagtcaaatcgatgataatccgtttcacgtcttcatcataaacgatggcattcatcagttcagacacggaagcaaaaaagatctgtcccgttaccttataagttctgacatctttctgttcggaatgtgacacaatcttcagcttagaaattttcgccgtaaaaaagatcgcgcttagcagcacacccgcgaaaacacccttcgataaatcatttgtcagaacgaccgtcacgacggtaatcaccataacgatcgaatcagtaaggggcgctttccgcaaacctttaatcgatgaccagtcgaacgtgccgatggacaccataaccatcacggccacaagcgcagccatcggaattttcacgacgataccgcttaatacggcaattaaaaacattaaaaacgctccggccgtaaaagccgacaaccggccgcgaccgccggctttcgtattaatgacagactggccgatcatggcgcatccggccatgcctccgaaaaacccgttcacaatattggcgatgccttgtccgcggctttctttgttcttatcactatccgtatccgtcatttcgtcaatgatctgggccgtcagcaatgactcaagcaatccgacgaatgcaagcgccagtgaatacgggaaaataatccgcaatgtctcaaacgtccacggaacatccggtatcaagaaatgcggaagtgaacttgtaatcccgcccatatcaccgaccgtgcggacatccgcatggaagaccaccgcaatgatcgtcatgacaataatcgccaccagcggagacggcacagccgtcgtaaccttcggcaaaagatatatgatagccagtgatccgacaagcatggcgtacatgacccatgaagctcctttgaactgcggcagctgcgcagaaaaaatcaagatcgccaaagcattcacaaatccgatcatgaccgaacgcggaataaatttcatcaatttcgctatcttactgacaccaagaataaattgaataatacctgtcaaaatggttgccgcaaacaaatactgcagcccgtaatcagccaccaatgtcaccatgacaaccgccattgaacccgtagcggctgaaatcattcccggtctgccgccgaagatagaaataataatcgcgatacaaaatgatgcataaagcccgaccatcggatcaacacctgcaataattgaaaatccgatcgcctcagggatcagagcgagagcaaccagaataccggccagaatgtctttacggacattcccgaaccattgctgctgtaacgtataatctttcaaatgataacgactccttttcactataaaaatccgcaccttatcagttggaaacattgatttttatctggggaatatgaggcaagcttacggggaaaaggggacacgctcagagtataatgtcttgaggaaaggaatggttaacaaagagtatcatattaaactttaaagaaatgtgcaagaccgtataaaaaagaaaagaaaacggctctcactggagccgtttccgcttttataaaagttccggatcagacacaagaatcgtttttattgcgctgatatcctttctttcttttgtcaccgggtcgatgcccatgagatgatcaatggcttcttcataattcttcagttccgtcttttccgtaataaaatcatagagctgcggaaggtcggatgcacatgctaacgcagcctccatgatctgacgggcttcacctgtgcccacaatcgttacgccgtttgacagcagctgatacggcctgactgtcatctcatacgtatcatcaaagcccatcggcacgattctgcctcccttttcaataaaaggataagcccaatcaagctgattgccgatcgcgtcaaaaattacatcaaattttcttccttgattaatccgtttcacttcatccacggttaatgcttcagggtggtagacataatccgatatccggctcgccgcctcgcttcggaaactgcctatttcagtcgcaaccgtcaatcgcgccagttttttcaccatcatttgcacaagcagtccgattggccccgaccccaaaaccaagaccgagtcctccggctgaatcgaagctttgtccacaacattcagcacacaggagagaggctcaaccaatgtggcccgctcccattccattgaatcgggaattctgtacatgaacctgtcttctccgacgtaatattccgcaaacgttccgtgcgccccgattccgagctgccaatcctcgaaggtttcgcaataacacgtcagccctctccggcaataatgacatttcccgcaaaactgcgtaggatctatcacgacgcggtctccgacttttacatttgtcacgtccggtccgatttccacgaccgctcccaccgattcatgccccataatcatatgatgggttgcattcatttttcctttcagcacatttaaatccgttccgcagataccggtgccgaaaattttcactttcacatcattggatttccgaatttgaggctcgtccacctcttgatattcaagcttatcattaggagtccagaccaacgccttcatatttctcttcctttctgccccagcggatttggtctaacaatgtttgatgaagctccttcgttgatgccgcaatacatgattgctggttctgataacttaaatctgtcagaagcgtttcgtccaaagaccggccgtatgcatccgtaatgaccactcctgctttcttcgccaaaaagacgcttgcggcaatatcataaggaaacaaatgcagcacctctccgtttccgacctgctgaaaatctgaaagcagcttcggatcatctttcagcagacgattgccgatatccacataagcatccatctgccccgtgataattcgtgaaatcgaataagaagcgctgttgaaaacaaaaaccccgccattattggctgaccggtcaatcagatgaccgtatgcatccgtcatcagctgtgccggatgcccgttaaactcaaggctccaaaacatatttttaatatcccgcacttcgctcaaattcggcaattctccctgatacccctcaaactgaatggcgtcgctgtaaatatcaccgtacatgtaagcgcccgatttcaattcaagcaaaaaagcaaattcgatatccttaatctttgcgtttggcttatacgaagcaagcgcaatcgaaatacacgacatttcaagccccgcggcggccggacgcgttccgtctatcggatctacaattaaaatatattgcggatcttctccaatcagcttcaggccgccatcctccgtgtaaaaagcaaccggatggcccttatcttgaatataatccagcaccgcctcctcagcagcggcgtctatgttaaattgggcgtcgcctcccggagaatagccgtttacgagccggtttttcagcgtgcctttttgacttttcaccttatgataaacaaattgtccaagcccgatgatatagtctctcacttgatttcctccaatagcttgcgaagtctgtagcagagcacttctgcttcactaagtgtaatagttaaaggcggtcggattttaaaaacatttccgaacccgtaacgggatgtccggagaatcagcccgtaatccattgcccgttttgcaatataattggtcagctccacatccggttcattgttctcttttacaatctccacaccgatcataagaccgacgcctcttacctcagaaataaaagcgaaatcctctttcatcgtttctaagcgatccataatataatgaccgaccgtcgttacattttccaaaaatcccggacgctgcatgatatctatggttttacacgcggcagcggcggccatcacatttgagccgtacgtgaaggagtgcgtataccccggaagcccggtatacttgtcctccgtcagagtggcggcgacttggaagcctgtgcccccgagcccttttgctaccgtcatcatattaggtttcacatcgaagtggtccgcggcaaacattttgcccgtccgtccgaacccggtctgaatttcatcaaaaatcagggcgatatcgtgttcatcacaaagctgtctcagctgtttaaaatactctttaggcggaacgacgtttccaccgtttccggatatcggttcaataatcatggcggcaatttttccattgctcgcatactcaataaaatcattaattctttctacgcacagcataccgcatgaatcaggtttctgattataaaaacagcggctgcaatacggatcggggacttgaaggccaaaagaaatttgcggcgggaaaggttcttttctgaatgagttgccggacaaagcggaagtcatatacgtttgtccgaggtggcttcgaaataaggagatgacatcggtttttccggagtaatactgagccattttaatagctccttcatttgcaccggaaccgctgctgactttagggtgtacttttgtgagattatcgggggcgatttctactagtttttctgccagtttatttacggcgtctgtttgaaaagatgatgtcacatggatcagcttatcggcttgttctttaaccgtatcaatgacttctttgttaccgtatcctaaattcaagttaaatgtggcagaagcgcaatcaatgtactcattcccctcttgatcgtacaggtaaatcccttctccgcgctccattactacatcgtcaacactgtaatacaagctgtctggattcgtgatttccttcgttcccacaaataccacccctatgaaattattagaatttcgctttttatcgtattaattattgaaaatattgtcaacgatctttcttgtaaaaaatgttaacaatttgttaacgttaccataagggatgtacgagaaaaagttatgtgatatagtaacaatacttggattttttgtaaaaacgtcatgtcatacgagtagagagaaatattattttacgaataaggagataaaatgatgaaatctcgtctgctgtggataagctgtttttcttatggatcgattgcttttacacttgttattctgggagccgtactgcctgagttactcacacattattcacaaagctacagtaatggcggtgtattggtattctctcagttcatgggctttctcatcggtgttattggcatgccatacatggtgaaaaagcttgggcgcaaaaacgtcgttatctttggcctggcactcatcagctgcgaaatgttcatcaccttcctgccgccctggccgctgctctttcttctcgtcagcatcgcggggcttggcgccggattggtggaatcctgtgtaggcacgatcatcctcaccgctattaaagaaagacaggctgtggccatgagcaagatggaagtggcctacggattaggcgcgcttttcatgcctctgctctcaggctttcttatcaacaaccacatgtggacaattgcttttttagtattagggttatccagttttgcacttttaatcgcatggaagcagatgagtttcggcagtattgatcagcttctcatccgaaaagaggtctcttccgatgacactaaaaaagaaagcaccggttatcggtcacacggattgctgtttattgccttggcgggggcttacttcttcttttacggaggcagtgaagtttcaattgtacattttatcccctccattttctctgagaaatgggatatccccaactctttggcaacgataacagttacagtgtattggacggggatgatcatcggaaggttactaacaggcccggtatcagaaaagctgacatatcaccgttatcttcgtctcataagcattggcggtctggcagcacttaccgtattagcactaagtaaaaacgtatggttcggctttgccctttgcttctttttagggctgttcatggcaggcatgtttgcaatagccctaatcatcacgaatcatttttatcccggaaagacagaaacgactaccagtattctgctcgcttcaaacggattaggaggttcactccttccgatcgccgtcggctggagcttagatgaatatcccgcacaaactgcgttctggctgtttactgcactgatggtccttatgctgctgattgtgttcagtttaagaatactcgagacaataaaatcaaacaatcttcaaaatcacaacagcaaagcaaaatcaatgtaaacaaaaaagctaatgcctttgaaaggcattagctttatatatctatgtgatctttcaaataaaaaaaccagttcatcatgaactggtttaagacagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacatctcgaagaatcgaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttaagttgtttccgaagctttttgttgttgtctgctgtccatcagcgacgtttaataatataccacggtgcttctctataaatcaagcattttttttaaaaagagaaaaaaagaaaaccagtatattatctttaaagcttgagaatggtcgggaagacaggattcgaacctgcgaccccatggtcccaaaccatgtgctctaccaagctgagctacttcccgattttaaaaaatattatggcgcgcccgagaggagtcgaacccctaaccttttgatccgtagtcaaacgctctatccaattgagctacgggcgcaatcaatttcacaatatcccgttgggataaaatggagcggaagacgggattcgaacccgcgacccccaccttggcaaggtgatgttctaccactgaactacttccgcaagtaaaagtgtaatacatggccagaatacagcttcagatagcggtaaaccgtattgttatttatactgttcattatgacaaaagtaattatatcaaggttttgataaaagtcaatatcgtttaacaattaattatgttaatctcttttgcatccttgaagaaaggcttcatcaggagacgcgctaaatacctacaccttaactggtacaatcagcaacaggtttttactgaactaaacaaaaaataacagttccataacattcggaaactgcttcagatcaacgtattttagataagcttccaagcgggctcgaaccgctgacctcttccttaccatggaagtgctctacctgctgagctatggaagcaatggctccgcaggtaggactcgaacctacgaccgatcggttaacagccgatagctctaccactgagctactgcggaatattataagcttcataaacaaaaacatggtagataaaataaaaagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaacatctcgaagaatcgaatgatccttcaaaactaaacaagacagggaacgttctgtttataagacccgaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattaccgcttgttgaagcagctttattatcttaccactcagcttcttttatgtcaacaactttttttaagttgtttccgaagctttttgttgttgtctgctgtccatcagcgacgtttaataatataccatgcatcggctgaatttagcaagtatttttttcgtttttttttgaaacgtatttcgttatattcatctccgccgcggcatacgatgtaatcaagcatggacaagataaggaggcgtcaccagtgaaccacttctacgtgtggcacatcagaaggataaaacagctgcttattattatcattgccgcatttgcagcagccagctttttttatatacagagagccgtcccccttcctgtatttttaactgatagcggcccgaaggctatttcaaaaggggagacgaaagcgggcgaagtcgcattaacattcgatatcagctggggcgatgaaaaagcggttccgattctgaacgcgctaaaagcaaacggtattaaaaacgccactttttttctgtcagcttcttgggcggaacggcacccggacacagttgaacgtatggtaaaagacggacatcaaatcggcagcatgggatatgcgtataagaattataccaacctagaggacaacgaaataaaaaaagatatccttcgggcccagaccgcatttaaaaagctgggtgtgaagaatgttcatttactccgcccgccgaccggacaatttaataaaaaggttcttgccattgcacagcagtaccgctattcagtggttcattacagcgttaactcgcaggattggacaaatcccggtcctgataaaatcattgaaaatgtaaacagtcatataaaaggcggcgacattgtcctgctgcacgcctctgattcagcaacacagaccgaagaagcgctccccgccatcattcacaatttaaagcaaaaaggactgaaaaacgtgacagtcggcgacctgatcgcaaatactgacgtcaagtcatcagaagtgaaataactacctctgggcaaacttcggcagcattaacagctgaaacgcattgcagcccatcagcggaatcagcatcaaataaagccagtcctcattattcactcttagcgcaggaacccattcaagcgctgtaataacgaccattaaaaataatgatgaaacgaacgtattttttgaggactgcttttgttttatatacgccgtcagcaagccgacggcaagcagagccagcggcagccagacaaaccccgcaatcgagtcatcccgctcaccgaaaaacaaaaatctgacgtacattaaatcaaaagcgacaaacagaatgataaacagctgaagcagattccaaagcgagtttgatctgaggatttcaagggcaaaccggtgcaccgtcagaaagacgaagaatcccatctggctgatcacactgaaaatcatgcctaccccgataaaccagatcagaacggagaaaatttgaccggcctcaaaattcagaaagaacccttgtactccccccacttcagtgcaaatcccacgacgcttgtaataagagcgcccacagctaaaatcgaaaagaaaaatcgaacaagcccgcggcttttcatctcttattcatccccctgacaatcgcgttcagcgatattttgttatgtataaatccattccgatgaatcatattaaaaataagtacaagtaaggaaggagcttatgcatgtcaaaagccaaaacgctattgataagctgttttgttgtattatctgtaacagcttgtgctccaaaagaccaagcagcggatatggattatgaccagactaaaaaaatggttgttgatatattaaagacagatgatggaaaaaaagcaattaaggaaatattaaatgatgatgcgatgaatgaggcattggtgattgatcaaaatgccattaaaggcacaatagagaaaaccctcacctctaaaaaaggggcggagttctggaaaaccatctttgaagactcaaagttcgccgagagctttgcaaaaacgcttcagcccgagcacgaaaaaatcataaaaaaattgatgaaagaccctgattatcagaaaagttttatgcagatcatgcaggaccccggcatggataaaaaatactatgagctggtgaaaagccaaaagttccgcagttacttagaagatgtaattacagagacactttccagcccgcttttcaaaaagcaattcgaggatgaattgaaaaaagcggcttcaagttctgaaaaagaaagccaataaaaggccgggccgtgttgatcccggccccttttttattcagctgttttttcaatgactttttgggcgatacccatataaatttccccgatcggatgacttctgtcatagacagaaggcgcaaactggtccttgtcccaatcaggctgttttaaaggaattctgccaagcagcggcacctgcaattcctctgcaagcttatctcccccgccttgaccgaacacatattctctctcgccggtttttgcactttcataataagccatattttcaatgacccctacaacttcatgatcggtcttaatcgccatagatcccgctctcgccgctacaaatgcggctgtagggtgcggcgttgatacgataatctctttgcagctcggaagcatcgtgtgtacatcgagcgccacatcacccgtgccgggcggcaggtcgagaacgatatagtcaacctctccccagtcaacctcatggaagaagttattcagcatcttgcccagcatcggccctctccacacaaccggagcgttttcttcgacgaaaaagcccatcgacataacctttactccaaatctttcgacaggaagcagtttttctccttcaactgtcgggcgaactgtaatacccatcatgtccggcacgctgaatccgtatatatccgcgtcgatcaagccgactttttttccgagccgcgcaagagaaatggccaggttgacggaaaccgttgatttgccgacaccgccttttccgcttgccaccgcaagaaagaccggcggatgtttcctattcagcagggtttcgctttcagcagcaggccggctgaatttcgccaatgtttcttccggcagctcttcaaaccgaagtcccacagtttccgcacccgcttctttcagaacggatacgatttcctgctgaatgcccatctgttcagccgtccccgtttttgccaatgcaatttttacactgacatgccgtttttccggcttgacctttacttctttaatggcatccaattctcccagcggtctatgaagaaaaggttcgcgcatgtttccgactatatttcttacttcatcttctcttatcatcgaaccctcaccctttgtgtattcgtttacaaatggtattataccatatattaaacgtagaatcggcgaaaaaccctccttactcgggagggtctcctttttctgtaaaatatctcaacacgcccttatacacggaagaagcgattttgtcctgatatttaggctggccaagccttttcgcttccgcgggattggacagaaatccgatttccaccagggcgcccggtttggttacattctgcattaagtaaatgccgtgtatccgtttcgcctttctcgttgtattctccaaattgattctcaattcgtcctgtatatattttgccactttttcattctcttcgtattttccatagtagaagctttgggcgccgctccatctcggtgacggtatggcgttcagatgaatgctgatataaagctccgcctctgaacggttgatgatctccacgcgctttctcagatcttccgctttgcgtctgctgtagcctttcgtcccttcaggagctaaatcagtatccgtctcccgcgtcataatgaccaaagctccctgctcctgcaaatagtctctgaccctggaggccacttcgagagtaatgtccttttcaaggtgactgcctcccgtggcgcctccgtccggcccgccgtgtcccggatcgagatagatgattttcccgctcagcggcaggctccacggccgccatgaatcatcattatggaattgaaaccggaataaacacaataatatgataaagccaagtaaaaaaccgagccatttcagcttttttgtcatagctttccctcccgcttgtccccgttattaataagtatgggacaagggaagaaattatgattacctcatgcggagcttacattgtttttctctttgcagaaatccttccgtccaccagctgttgataaaccggcaggacgcttcatagatttctttttgttcaacggaagaatattgctcatgcgtccaattgcaaagatattcaaaaaaatcggccgtcagttcttcctcttcttcagccgaacgggcgttcgccctctgcaaagactcaccataaaatccaaagacgccgaaccggccgcctaataaatacgcttcaattgcaaaatctatgcatccttcactcagaatgccgttttcgtcttgaagaaagggaaacaaaggggtgagacatgcttttacggactgaatgatctgcgtcagtgacagctcctttagtaaactcttctcaagctcataatccttctgccgtttcacgtctgaaaaagataatacttctgccattgccagccacgctcctttttactgttattttgaaaggaaaagggaaaaagcatgctttgttgatagtggaaatcctcccaaatgaaggagtttcatgttaactggaagaataaagagctgaggtgacgtgatgaaaaagctgtttcaatacaattggacggtgcgtgacgagtggtttatgatatgtgaaaagctgagccgggaggaactgacgaaaacccggacgggcggaatggagagcatcttgcggactttatttcatatcattgatgtcgagatcagctgggctcgtgccattttaggtaaagatgatgttttacccgctgagtctgactatacgagcattcaggatctcagaaagctgtctgaacagtatcgggaggatgtcattcatgcggtctcccgcaaaggggcggatcttgttaagccggactggatggaccaaacctttcctaaagaagatattctccgccacatccttgcgcatgagattcaccacatgggacaactgtcggtttgggccagagagattggaatagaaccggtttcggctaatgtgatcagccgtccgcaggaaaaagccgcaaaaaaacagcacctctgacgggatgccgtttttatattttaatgcttcttgttacggagtatgtattaatgtattcatccagcacgaggccgcctttgtcctcgtaaaaaccggcaaccataaagcctgcgtcaatctgacctttaatttgatcctccagcgtatggccgaattcaagcgcttcatgattatcaataagttcctttacctttttcttactcagatctttttcatccgaaaacggaatggaatactttacttttagtacgccttcctgctctaaatccatatcaaataagaacacgacgggatttacaaaaccggagactaaagacccgccttttttcaatacgcgataagcttctttccataccggaagaaccgtatcaacaaagcaattcgataccgggtgcacgataaaatcaaatgtctcatcatcaaaacagctcagatcattcatgctgcctttgacagtccgaagcgtaagaccgtcccgctgggcaaccattctgtcttgcgcaagctgtttttccgaattgtcaaagatggtgacgtccgctcctgcagcagcaaggaccggcccttgctgtcctcctcctgaagcgagacaaagaacctccagaccgtctatgggcggaaaccaatccgccggcacatcttttccgggggtcattctgatgctccaattgccttttttcgcttcaccaattgtatgagaatcaaccgcaaccgtccattcattgcctgtttcgacttttttatcccatgccttgctgttatgtatgactaacttattcattataactgcgctccttattggtaatgaatagagtataacaaacaattctagaaaaacatcggataacctcttcgatatgagaaaaaaatacaaaaaaaccacaaccaagaagttgtggtttttgccatccaaaacgattaacgttttgagaactgaggtgcacgacgagcgcctttaagaccgtattttttacgttctttcatacgggcgtcacgagtcagaagaccagcacgtttaagtgttgcgcggtattctggatctgcttcaagcaaagcacgagcgataccgtgacggattgctccagcttgaccagataagccgcctccatgtacgtttactaaaacatcataagtaccagctgtttcagttaaagttaatggttgtttgatatcttcgattagagccggagatggaatgtgctcgctgatttcacgattattaacgacgatacgaccttctcctggaactaagcgcacacgcgctacagaacttttacgacggccagtaccgtaatattgaacctgtgccaaattggtaacctcctttttaattaaccgcgaagttcgtaaacttcaggtttttgtgcttcatgtggatgctcagaaccacggtatacgttcaatttcttgaacatttgacgacctagagaaccttttggaagcatgcctttgatagcaagctcaagcattttctcagggtagtttgtacgcatttcaagagctgttcttgatttcagaccgcctgggtgcattgtgtgacggtagtagattttatcagttaactttttaccagttaactcgattttttcagcgttgatgatgatcacatgatctccagtatcaacgtgcggtgtgtaagtcggtttgtgtttcccgcgaaggatagatgcaacttctgtagaaagacgtcctaaagtcttgcctgctgcatcaacaactaaccacttgcgttcaatagtacttgcgttagccataggtgttgtacgcatttaattccctcctaaatgatctgtcattttttcataaacttctgttacgttctatttcacaacacaataagttccggggcttatcgtggggttgaaatacataccatatgatatcttataactttatgcagactctgtcaagaaaatgttacacctggtttagttgtcatagcaaacgctccataaatacagcccgtgccccggtgcggtgcgccccgcggcttcgcgatccttcgcttcgagcattgcttttacatcatcgggagaaaattttccagctcctgtatccaataacgttccggcaatgattctgaccatattatagagaaaaccgtttccggtgatccgcatctgcaggccgtctccggtctcagtccaatccagctcgtaaatcgttctgaccttatcctgaaccgcggtatcagccgcgcaaaagcttgtgaaatcatgtgtcccgatgaggtgccttgaagcttccctcattttctgcacattaagctgatatgcaaaatggtaagcgtaatgtcgtttaaatacgtccgggtgtttctccgtatatacaaagtagcgatattccttttggactgcgctaaatcgtgcatggaacccatcatccgcaatctctgctgttttgacggcaatatcatcaggcagcagggcattgagcgcaaacggccatttctcagccgggatggacagcggcgtatcaaaatgaataacctgcccggcagcatgaacatcgctgtccgtgcggcccgatgagatgacaggcaccctgccgtccgttttatggatgacggccagcgctttttccaattcactttgaacggtccgctttccaggctgaacctgatatccgttaaataaatgcccgtcataagcaatggtacatttcactctcattcagcagcacctctaacttcttaagaaaaacaataacacggctaatacgatgatgagcagaatggctccggtatcctttccggtccagacgagctttctgtatttcgttctcccctcaccgccctggtagcctctcgcctccatggcgaccgcaagctcttccgcgcgtttaaaggcgctgacaaacagcgggacaagcagcggaacaaccgctttgattctgtctttcaccgggccgcttgtaaagtccgcacccctcgccatttgcgccttcatgattttatctgtctcttccatcaatgtcgggataaatcgcaatgatatcgacatcatcaatgcgagttcgtgtacgggcagcttcacctttttaaaaggattcaagagctgctccattccatccgtgatttcaatcggcgttgttgtcagcgtcagcagcgttgtcataaagataaggtaaacgaaacggagggagataaaaatcccctgtataagtccgccctcatacactttaaaccagccaagctgaaaaatgacagatccttcatgcgtcatgaaaatgtgtaataaaaaggtaaacgccacaatccagataatcggcttaagccctttcagcaaaaagctgaacggcactcgtgttaaggcgatcaccccgaatgtaaacaaaccgagcaaagcatacgtttgtacgttgtttgccaaaaaaacgatacatacaaaaagaaagatgctgacaagttttgttcgcgggtccaatcggtgaataagcgatgatccgggaacatactttccgataatcatgctgtccatcattggtccttttcctcctgaaagaaagccttaatttcgctcgcggcatcctgcagggtcagcatgggtttttcatacttaactccgagagcctcctcaagccgtctctgaaacttcaccgactcaggaagatccagtcccatttcggccatctcttcaccttttacaaacaagtcacgcggactccccgtcgctttaatggtgcctttgtgcatgacgatcatttcgtcagcatagcgggcggcgtcctccatgctgtgggtgacgagaacggtagtcaggtttccccgctgatgaagcgcatagaacatgtccataatgtcctggcgccctctcggatcaagaccggctgtcggttcatccaaaaccagcacttccggctccatcgcgagaacgccggcaatcgccactctgcgcatctggccgccgctgagctcaaacggtgaacgatccaaaatgtcttccggaaggcccacaagccccagcatttcttttgctttccgttcagcgtcttctttttttacaccgaaattcatcggtccgaatgcgatgtccttcagcacagtctcttcaaacagctgatgttcgggaaattggaaaacgattccgactttttttcgcagagtcttaaggtctttattctttttaccggctgccagaatcgtgctcccgagctcaagctgtcctttagtcggtttcagcaaaccgtttaaatgctgcaggagcgtcgatttgcccgaccctgtatgtccgatgacggcaacgtagctgccctcttttatcacggcattgatatcatacagagcaagccgttcaaacggtgtcttcatttgatagcggtgttctacatctttgattttaatgtccacagctcattcaccagcccttcctgagtcagatggtttttcgttaacgccagtccgctttctttcaaaagcaggctgagctggaatgagaaaggcaaatcaagaccgatgcgaaccaagtcttcatttaatttaaaaatctcttcaggcgtgccctctgcatatttcctgccgccgttcatcacaatgatcctatccgcccttgcggcttcttccaggtcatgtgttatcgaaatgacggtggccatgccctgatcttttaagcgtctgacagtatcaaggacttcttctctcccaatcgggtcaagcatggatgtcgcttcatccaaaatcataatatcaggacgcgcggcaataattcccgcgatcgccactctttgtttttgacctccggagagatggtgcggctcttgatcaagaaaatcctgcatattgacttgtgtgacagcccaatctactctctcaatcatttcttcgcgcggaacaccattgttttctaaaccaaaagccacatcatcgcgaacagtcgttccgacaaattggttatcgggattctgaaagaccatccctattttttttcgcacatcccacacggtatcctcagtcagcttgatgccgccgacttcaatttctccggcctcaggcaaaatcagcccgttcagcgctctggccaaagtcgacttccctgaaccgttgtgacctacgatagcaagccattctccttcatatacctccagactcacaccgtccagcgccggtcttactgcatctttgcggtagcggaatagaatgtcttttacggatataagctgtttttgatccacgggcgcctgacctcctctcagctatagctctgcttttctgtctcatgataaaaagttctgatatctaaaaaaagggcatagatccagttagaaactgtcccgcccttctttagatacacaaaaatatgtgattaaaccaattcgatgattgccattggtgcaccgtcaccacggcgaggaccaagcttcataatacgtgtgtatccgccttggcgctcctcgtaacgagttgcaatgtcagagaataatttttgaagtgcatcttggttattttcttcattagcaacctcgttgcgaatgtatgcagcagcttgacgacgagcatgcaagtcaccgcgcttaccaagagtgatcatcttttcaacaacagagcgaagttctttcgcacgtgtttcagttgtttcaattctttcgttgatgatcaaatctgttgtaagatcacgaagcatagctttacgctgtgaactcgtacgtcctagttttctgtatgacatgtgatgtcccctcctttaatggaatgctgtttctaattaaaaaacacacgaaaatcctagttcacatggaaactagatcaatcgtctttgcgaaggccgagtccaagttcttcaagtttcgctttcacttcttcaagtgatttgcgtcccaggttgcgaactttcatcatatcttcttccgtcttgttcgcaagttcttgaaccgtgttaatgcccgcacgcttcaagcagttgtaagaacggacagaaagatcaagttcctcaatcgtcatttcaagaactttttctttttgatcctcttctttttcaaccatgatttcagcatgctgagcttcgtcagttaaaccgacgaatatattaaggtgttcagttaaaatctttgaaccgagagcaattgcttccttcggtccagtgcttccgtcagtccaaacatcaagtgtaagtttgtcatagtttgcaacctggcctacacgagtgttttctacctgataagataaacgagaaactggcgtaaagattgaatcgatcggaatcacgccgattggctgatcgtctcttttgttcgaatcagcaggtgtatacccacgtcctctttgtgcagtaaggcgaactcggaaactcgcattctcaccaagagtcgcgatatgaagatccggattaaggatttcaacatcgctgtcgtgtgtaatatcagctgctgtgacagttccttcgccctgtacatcaatttcaagcgtcttctcttcatcagagtagattttcaatgcaagctttttaatgtgcaagattatcgttgtaacatcttccacaacgccttcgattgtcgagaattcgtgcagtacaccatctatctggatcgatgttacagcggcaccagggagtgaggataagaggatacgacgtaaggagttacccagagttgtaccatatccacgctcaagcggctctacgacaaacttaccaaatttggcatcgtcgctgatttcaaccgtttcgatttttggtttttcaatctcgatcattacttaaaaccctccttcaaaacgtcgaaacctcgaatagaatcatatgagattccatccgaaattccccattgtttagtcccgtatgtgctcaggcaacgagtcggtgcattcgtttcataaataactgtatcataacccattattgacagggacacaaaatctatacaaacaaattacacgcggcgacgttttggtggacggcatccattatgaggaacaggagttacgtctctgatagctgtaacttcaagtccggcagcttgtaaagcacggattgcagcttcacggccagaacctggtcctttaacagttacttcaagagttttaagtccgtgttcgattgaacctttagcagctgtttcagcagccatttgcgcagcaaaaggagtcgatttacgagaacctctgaatcctagagctccggcacttgaccaagaaatagcattaccatgagtatcagtgatcgtaacgatcgtgttgttgaaagttgaacgaatatgagcgattcctgactcaatattctttttcacgcgacgtttacgcgtgttttgtttacgagcagcagccattgtttaggtacctcccttacttattttttcttgttagctacagtacgacgcggacctttacgagtacgcgcattgtttttagagttttgtccgcgaacaggcaaacctctgcgatggcggattccgcggtagcttccgatttcgatcagacgcttgatgttaagagaaacttcacggcgaaggtcaccttctactttcagtttgtcaataacatcacggattttaccaagttcttcttcagtaagatcacgcacacgagtatcttcagaaacaccagcctctttcaagacttgctgagccgttgtgcggccaattccgaagacatatgttaaagaaataacaacacgtttgtcacgtgggatatctacaccagcaatacgagccattctctgggcacctccttattaattatccttgtttttgtttatgctttggattttcacagatcaccattacttttccttttctgcgaataactttacatttctcgcagattggtttaactgatggtctcactttcatgtgtttccaacctccttcagtttccggagtgctttatttgtaacggtacgtaatcctgccacgagttaagtcatatggagataattctaccgtaactttgtctccaggtaaaatgcgaatgaagtgcatgcggattttaccagatacgtgagccaaaaccgtatggccattttcgagttcaactttgaacatcgcgtttggcagtgtttcgacaatcgtaccttccacttcaattacatcgtctttcgccattcaagtgttctcccttcttcaaatcagtaacttgctctctgacaaatttcaaaagagaaaatctcagttatccgtttgtcacacgccctgtttcgtttatactgttctgaacttccggagatacgcaatcataaagggtgaatgattgatattctttttctaaggagaatgaaatgtacgcttttctccgtctgctttagtacacgatgatgaatcttccttccgatgacagcagctagccggtttttcttccgaccaattgtaaacctacaatctgcccaggtgcggaatgaaaaacatgtgtcatggaattcatttcatcatctagacttttgtcagtatatcaaaacccgtttccgtaatcgcaatcgtatgttcaaaatgagcacactttttcccatctaccgttacaaccgtccagttatcagccaatgttttcacataccggctgccagcgttaaccatcggttctatagcgagaaccataccaggcttcagcctaggtcctttgtttggcggaccgtaatgaggaatttgcggatcctcatgcaagtcttgaccaacaccatgtccgacatactccctaacaactgaaaactgctcattttcgacatacgtttgtattgcgtgggaaatattcgacaaacgttcacctggttttgcttccttcaagcctttatataaagactcctctgtcacttccagcagtcgtttatcatcatcactgatgtttcctaccggatatgtccaagcagagtcaccatgataaccatttaatttagcaccgatatcaatgctgataatgtcaccgtcacgcaaaacccttttaccgggaattccgtgaacgagttcttcattaactgatacacagatgctcccgcgaaacccattataccccttaaaagatgggattgcaccctgcttctcaataaaacgttcggcaatttgatccaattcttttgtcgagattcctggtttaatgtgctttttcatctcttcatgagtcaaagccacgattcgccctgcttcccgcatgatgctaagctcacgaggggtcttacagataatcatttgctcaatcctccaagaagctctttcacatctttgtacacgtcgttaatgtcctgctggccattgacgttgacaagataccctttctcagaataaaaatcgagtaaaggctgagtctgcttcatgttgacctcaagccgttttgagacggtttcctcattatcatctgcccgttgataaaggtctcctccgtctttatcacaaacacccggcgttttcggcggattgaaaaccaaatgataggttgtgccgcaaacactgcaaattctgcgtccagtcaaacgttccattaaagagtctttgtctactttaatgttaatgacataatcaatcggcttgccgtattcctcaagaatgttttcaagagcttcagcctgagcgactgttcgcggaaatccgtccagaagaaaacctctttcacaatcatctttgccgagtctttctttgacaatgccgattgtgacttcgtccggtacgagctcgcctttatcaatataagactttgcttcgagtccgagtggtgtttcttctttcatagcagcacggaacatatctcccgttgagatatgaggtatcccataatcctcaacaattcgttctccctgtgtgcctttaccggctccaggaagtcccattaagactaagttcattcggatttcccccgtcctctcttatttagaggaatggttaaaaccagtcctctaatttttcataaatcctcggtaattacgtttcactaactggctctccagctgcttcattgtctccaaggctaccccgacgacaattaacaatgatgttccgccaatctgtgcactttgaggcaatccagcgaattgaatgaaaaagataggaagaatggaaatcacggctaagaatatagaacccacaaacgtaagtcgatacaaaatgctcgtaattctatcttgagtcattttccctggacgaacccccgggatatagccaccctgtttttttaggttatcagccatttgttcagggtttacctgcacaaaagcatagaagtacgtaaaggcgataattaatgcgacataaaccgtcatgcccaccggatgtgtattgtcaaagttggcttgaatccactttgtcacatcgttttctccgaaaaatgacgcgatagtacgcggcgtaataaggaacgcaaccgcaaagattaccggaataacccctgccggattcactttaagcggaaggtgagttgactggcctccgccaacaggtgaacgaccttgcccttttgcatattgaatcgcgattttgcgtacagcctgctgaatgaaaataacaccaacaataacggctaaaatcgcaatcaccagtaaagcgattttcacaatatgaataaacagctgatcgctgctgccgacaaattgagtctcataaatctgcccaacagttttcggaatactagccacaatccccgcgaagatgatgatcgaaattccgttacctactccattggaagtaatttgttctcccagccacattaaaaaagcagttcctccagtgagtactaaagcaataatcagatatgtcgatatgccggatttttcaatcagcataccgtttgccaggttgttaaacccgtaagacatacctaatgcctggataaaaccaagcacaatcgtaaaatatctcgtgaactgagctaatttacggcggccgacttcaccttgcttagaccactcggtaaacttcggcacaacatccatctgaagcagctgaatgatgatcgaagcagtgatgtaaggcgtaattcccatcgcaaaaatggagaactgataaagcgcaccgccgccaaatgtgttaaggagatcaaaaacccccatcgaactttgtgtctgcaacgcctgagcatttacatatggcacagggataaacgcacctatgcgaaagacgataagcatgagtaatgtaaaaatgattttattccgaatatcactcacacgcataaagttggagattgtcttaaacaagttagatcacctcagctgtaccgccagcagcttcaacagcttctttcgcagaagcagagaatttattggcttttacagttaattttttctctaatttaccgttgccaagaatctttactcctgcattaagtttgctaataacaccagtctcaagaagaagttcaggagtgacttccgttccttccgcaaaaccgttcaatttgtctacgttcacaatagcgtattccttacggttgatgtttgtaaaaccgcgcttaggaagacgttggaataaaggcatttgtccccctcgaatccagggcgtacaccgccgccagaacgagcgttttgacctttgtgacctttaccagctgttttaccgttaccagaaccaataccacgacctacgcgattgcgtactttacgtgaaccttctgaaggctttaattcatgaagtttcattaggacacctccttagcctataatttatttttattgttctttaacagaaactagatgagatactttattaatcataccgcggatcgcagcgttatcttcatgaacgacagtttggtttgttttctttaaaccaagtgttcttacagtaacgcgctgatcttccgggcgaccgattacactgcgtttgagggtaatttctaatttagccattaatgttccctccttatcctaacagttcttctacagattttccacgaagcttcgcaacctcttcggcacgtttaagctcacttaaaccttgaagtgttgcacggatcatgttgatcggtgtgttagaacctaaagacttagaaaggatatcagcaacgccagcaagctcaagtaccgcacgtacagggcctccagcgataactccagtaccttcagaagcaggtttcaacaagatattgcctgcaccgaaacgtccgatgatttcgtgtggaatcgtagttccaaccattggtacttcaatcaaattctttttcgcatcttcaacagctttgcggattgcttcaggtacttcttgtgctttaccagtaccgaaacctacgtgaccgtttttgtcaccgacaacgactagagctgcgaaacggaaacgacgaccacctttaacaactttcgctacgcggttaaccgtaactaagcgttcttctaactctaatttgcttgggtcaatacgacgcataatcatgtgtccctcctttttttattaaaatttcagtccggcttcacgagctgcatcggccagagcttttacacgtccatggtataagtatccgccgcggtcaaatactacgtcagaaacacctttctcagaagcgcgtttcgcaacgagttcaccgactttagcagcagcagcgctgtcaccagtgctttccacgttcaaatctttatcaagagtagaggcactagcaagtgtaacgccatttacatcatcgatgatttgagcataaatgtgtttgtttgaacggaacacattcagacgaggtctttcagctgtgcctgaaagtttagcacgaacacgggcatgtcttttttgacgagcagcatttttgctagttttcgtaatcatccttaggtcactcctttcttcactttaagcggtcttacttagcagatttaccttctttacggcgaacaacttcaccttcgtagcggattcctttacctttgtaaggctctggagaacgtacagcgcggatgttagcagcgatagctcctacacgctctttgtctgtaccttttacaactactttagtttgagaaggaacttcgatttcgatgccctcttcaggaacgatctcaacagggtgagagtatccaacgtttaaaacaagtttgtttccggatttagccgcacgataaccgacaccgactaattccaaacctctttcaaatcctttagatacgccttcaaccatgtttccaagcagactgcgagtcgtaccatgcagcgcacggtgctctttgtgatcagaaggacgagtaactgtaagcacgttgtcctcaattttgatttccatatcaggatggaaagtacgagttaattctccttttggtccttttacagctacagtgttgccttcgttcagcgttactgtaactccagaagggatctcaagcagttttttacctacacgagacatactaaaacacctccattcttgttaaacttcttaccaaacgtatgctagaacttctccaccagcttgttttgcacgggcttctttgtccgttaaaacaccttgtgatgtagaaataatcgcgattccaagaccgttaagtacgcgaggtacttcatttgatttagcgtatacacgcaaacctggtttgctgattcttttaagaccagtgataacgcgctcgttgttttgtccgtatttcaagaaaacgcggatgataccttgtttgctgtcttctacgaactcaacgtcacgaatgaaaccttcacgctttaaaatgtcagcaatttctcttttcaatttagaagcaggaatttcaagcttctcatgacgtaccatgtttgcattgcgaatacgagtcagcatatctgcaattggatctgtcataaccattatataattacctccttcccattcttggggattaccagctggcttttttcacgccaggaatttgtcctttatatgcaagctcacggaaacaaatacggcaaagtttaaatttacgaatgactgagtgcggacgtccgcagcgttcacagcgagtgtactcttgcactttaaactttggtgtacgttgttgtttcgcaatcattgactttttagccacgatttcgcctccctttcattgattatttctggaacggcatacctacttgagttaatagctcacgagcctcttcgtcagagttagcagtcgttacgataacgatgtccattccgcgaacctttgttactttatcgtagtcaatttcagggaagattaactgttctttgataccaagagtgtagtttccgcgaccgtcgaaagatttcttagaaatcccgcggaagtcacgtacacgcggtaaagatacagaaataagtttatcaaggaaatcatacatgcgctctccgcgaagagttactttcgcaccgataggcattccctcacgaagacggaatccagcaattgatttcttcgcacgagtaacgacaggtttttgacctgcgataaacgttaattcttcaacagcactgtcgattgcttttgcgttttgaacagcatcaccgacacccatgttgattacgattttttcgatttttggcacctgcataacagagtcgtagttgaacttcgtcattaaagcaggtgaaatttctttattgtacttttctttaaggcggttcatgagatagacctcccttcctttaaatactatttatctaagacttgcccagatttttttgcaacacgaacttttttgccatcttccactttgtatcctacgcgagtcacttcaccagttttaggatcgagcggcataacgtttgatacatgaattggcgcctcttgattagaaataccgccttgagggtttgcttgagttggtttagagtgcttcttcaccatgtttacgccctcaactagaacgcggtcctttttagggaaagcagcaaggatcgtaccttgtttgcctttatctttaccagagataaccattactttatcgccttttttcacatgcatcctgatcgcacctccttgagtaaggcatttatttcattagataacttctggagccagagaaacaattttcatgaagttgttttcacgtaattcacgggcaaccggtccgaagatacgagttccacgcgggctcttgtcgtcacggatgataacacatgcattctcatcgaagctgatgtatgatccgtcagatctgcgtgctccgctttttgtgcgaacgataacagctcttacgacttcaccttttttgacaacgcctcctggtgttgcttgtttaaccgtgcaaacaattacatcaccaatgttagccgttttacgtccagaaccgccaagaactttaatagtaagtacctcacgcgcaccggagttgtcagcaacttttaaacgagtctcttgttgaatcattatttgttacctcccttcggaaaaagaattccgaactttattagataataacagcttcttcgacaacttctactagacgaaaacgcttagttgcagataatggacgagtttccatgatctttacgatgtctccgattttagcttggttattttcatcatgtgctttgaatttctttgagtattttacgcgtttaccgtaaataggatcctttttgtatgtttcaacaacaacagtgatggttttatccattttgtcagaaacaacacggccttggtaaactttgcgttggttacgttcgctcatgctcacgacctcccctcagtgattatttgttggcagcaatttctctttcacgaatcacagttttcatgcgcgcgatagctttgcgcacttcacgaatgcgagcagtattttcaagttgtcctgtcgctaattgaaagcgaagattgaaaagttcttctttaagagactttactttttgttcaatttcagcagtggtaaggtcacgaatttcattagctttcatttgattcaccaccaatttcttcacgttttacgaacttcgttttaattggcaatttgtgagatgcaagacggagagcttcacgagctacctcttcagacacaccagaaatttcaaataaaactttgcccggttttacaacagctacccagccttcaggagcccctttaccggaacccatccgtacctcaagcggtttagcagtgtaaggttttgaagggaaaattttaatccaaactttaccgccacgtttcatgtaacgagtcatcgcaatacgtgcagcttcgatttggcggttcgtgatccaagaagcttcaagagcctggataccgtactcaccaaaatgtacttcagtaccgcctttagcgcgaccgcgcatttttccgcgatgctctctgcgatatttaacgcgttttggtaataacatattattttcctccttcctcagttttcttcttagtaggaagaacctctccacgatagatccagacttttacaccaagcttaccgtaagttgtgtcagcttcagatgttgcatagtcgatgtcagcacgtaaagtgtgcaatggaacagttccttcactgtagtattcagaacgagcgatatcagctccgccaagacggccggaaaccattgttttcacaccttgtgctccagcacgcatagtgcgttggatttgttgtttctgcgcacggcggaaagaaatacggttttctagttgacgagcgatgttgtcagctacaagctgagcatcaagatctgctcttttgatttcaagaatgttaatgtgtacacgcttgccagtaaggctgttaagggctttacgaagtgcttcaacttcagatccgcctttaccgattaccataccaggcttagcagtgtggatcgtaatgttaacgcggtttgctgcacgctcgatttctactttagaaacagaagcgtcagaaaggcgtttgctaatgaattcacgaatttttaaatcttcgtgcaggaagtcagcgtaatctttaccagcgtaccacttagattcccaatcacgaatgactccgatacgaagaccgactggatttaccttttgacccactacttatccctccttcttttctgatacaacgattgtaatgtggctcgtacgtttgttgatttggctcgcacgtcccatagcacgcgggcggaatctttttaacgttgggccttcgtcaacaaatgcctgagaaataaccagattgttagcgtccatctcgtagttgtgctcagcatttgcgatagcagattttaaaactttttcgatgatcggagaagcagctctcggagttaggttcaagatagatactgcttcgcctacttgcttacctcgaatcaggtccattactagacgtgctttacgaggagcaatacggactgttcttgcaacagctttagcttgcatttaaaagcctcctctcttagcgtcttgtttttttatcgtcactggcgtggcctttgtaagtacgagtcggtgcgaattcgcccaacttgtggcctaccatgtcttcagaaatgaatacaggcacgtgtttacgtccgtcatatactgcgatagtgtgaccgataaattgtgggaaaatagttgaacggcgagaccaagtttttacaacttgtttcttgtccgtttcatttaatttctcgatttttgtcatcaagtgtccatcgacaaatggtccttttttcaagctgcgagccattttggaacctcccttcgtgattgcactacggtccgaaatgaaccgtagacaaccccgttatttatttttacgacgacgtacgataaatttatcagatttgttctttttcttacgtgtcttgaatccaagagtcggtttgccccaaggagacattggtgatttacgtccgattggcgcgcgaccttcaccaccaccgtgcgggtgatcgttagggttcattacagaaccgcggactgtagggcggatgcctttccagcgagagcgtcctgctttaccaacgttgataagttcgtgctgctcgttacctacttgaccgatagaagcgcggcaagcagaaaggatcatgcgaacttcaccagagttaagacgtacaagaacgtatttgccttctttaccaagaacctgagcagatgtaccagctgaacgtacaagctgtccgcctttaccaggttttaattcaatgttatgcacaactgtaccaacagggatgttgataagcggaagtgcgttacctactttgatgtcagcttcagggccggacatgatttcagtacctacttgaattccttttggagcaagaatgtaacgtttttctccgtctacatagttgattagtgcaatgttagctgaacggtttggatcgtactcaactgtagcaacgcgtccaggtataccatctttatcgcgtttgaagtcgataacacggtattggcgtttgtgtccgccaccttggtgacgtacagtcaatttaccttggttgttacgtccgccttttttgtgaaggggcgcaagcaaggatttttccggctggtcagtcgtgatttcagcaaaatctgaagttgtcatgccacgacgtccgttagaggtcggtttatactttttaatcgccattttgaatttccctccttctttttacagataattaagcttcaaaaatttcgatttctttgctgtctgcagtaagttttacgatcgcttttctgcgacggctagtcataccagtatagcggccgacacgttttgatttccctttgtagttcatgatgttgactttgtcaactttcactccaaagatactttcaactgcatctttcacttctgttttattagctcttacatcaacttcaaaagtatatttcttttcagtcattaaatcagcagaacgttcagtaatgacggggcgcttaagaacatcacgaggatctttcattatgcaagcacctcctctactttttcaaccgcagcttttgtaatcagaagcttctcgtggttgacaacgtctaacacgttgattccgttagcttgaacaactgtaactccagggatgttgcgtgcagaaagagatactgcttcgtttgcatccgcagttacgattaaagcttttttctcaacagataatcctttaaggacagctgccatttcttttgttttaaccgtatcaagagtaagatcttcaagaacaataatgttgttgtcgttcactttagaagacaatactgatttgattgccaagcggcgaacttttttaggtaatttgtaagaatagctgcgtggtgttgggccgaatacgacaccacctccgcgccattgcggtgaacggattgaaccttgacgggcacgacctgtacctttttgacgccatggtttgcgacctccgccgcgtacttcagaacgattttttactttgtgagatccttgacgtaaggaagctctttgcataagaatagcgtcgaatactacgctctcatttggctcaattccaaatacagaagcgtttaattcgatatcaccagcagtagaaccgttttggttgtataatgctacttttggcatgatcaatttcctcctttcctaagagacttatttagatttaacagcacttttaacagtgattaaagcttttctcgcaccaggtacgttacctttaatcaaaagaagattgcgctcagcatctacttttacgacttcaaggttttggacagtgatttgatctccgcccatgcgtccaggtaatagtttacctttgaatacacggttaggatctacaggtcccattgaaccaggacgacggtggtagcgtgaaccgtgagacataggtccgcgagattgtccgtggcgcttgattgcaccttggaaacctttacctttagatactcctgttacatctacgatttctcctgcagagaaaatttcaaccttgacttcctgaccaatttcatacgcatccatatccacgccgcgtaattctttaacgaagcgcttaggagcagtttccgcttttgcaacgtgtcctttttccggtttgtttgaaagcttttcgcgcttatcgtcaaaaccaagctggatcgcttcatagccatcattttcagctgttttcttttgaagaacaacgtttggagctgcttcaataacagttaccgggataagatcaccgttctctgcgaatacttgcgtcataccaatttttcttcctaagattcctttggtcattcgtcacacctcctattaagatcattctatattttagaattaaagtttgatttcgatatcgacaccagatggtaagtctaatcgcatgagagcatcaacagtttgtggtgttgggttcacaatgtcgattaaacgtttatgtgtacgcatttcaaattgctcacgagaatctttgtatttgtgcaccgcacgaaggattgtgtaaactgatttttcagtcggcaacggaatcggaccagatacgctggcaccagaacgttttgccgtttcaacaatcttctctgcagattgatcaaggattctatgatcatatgcttttaaacgaatacgaattttttgttttgccattattttccctccttttcgcctacatcacgttagacagttctccgtgagaaaaacctgatcaccttgccatggcaaagcggccgggtgtgtcagcaacctctcacttcatcgcagtcaaagaccaacatacactattatacagaaaatagacgcatgttgcaaggtttatttaaagaaccttgtggttttcacactttgattattatacaggtgataccatgattaatcaaggatatgactgttttctttcagagatggaacgatgcgaaccggctgacaacttcggcaaagcgatccggttcctccaagtgaggcgaatgggctgagttctcaaaccaatgccattctttatacggcgcatcaaccttctgataatattcataagacgtcgtccccggaaccgtcaaatcgtatctccctgacataaaacagcacggtattacaatagaagaaactgattcccctgcatcaaaggaaatgagatcctcccacaggtgtttcaggctgaacatttgtccccgcgcggctaagaagctccctctcacaccgtacggttcaccaaacagcattcgcccccctgctttaagagcgccgatcggatgatgggtaaagccccctcccctcatttcaatacaaagcagaaacagcgttcgctgcagctgtttctcccatgggggtgctccgataaagctcagcgtcttgcccagcaggatatgtttgtgttgcctgctccattccatcatcaaccggtaggcttccgtttcttccttttgaatattaaccacctgactgataccgatatacgcataatacaaatcaggtttctcttgaagaacttgaagcgccaaaactgaaccccacgaatagccggcgatatatatttttctcctgctgaattgcttgcataagcgttcggtcagatgaatggtgtcagctgtcagctgatccaaagtcatagatgaacccggaatttcctttgaataagagagacccgcccctctctgatcccagttcacaacggtgaaatgcttttccagctcattctggtattttctcgcataaccgatttgaggcgtgccgggaccgccatgcaaaaacaaaagcagcggactactcctgtcatcaccattaatcataatggtttgttcactgccattaatctgcaattgctgaagcattgaaatacgattggttttcttgaagttatcgttcatcggtctgctcctaaaatttgtatacgttctattatacatggaatcagcagggaaacaaaaaaacgaggccccataagggaccccgcattattgaacgagtcgattactcagtgattgtagaaacaacgcctgaaccaactgtacgtccgccttcacgaatagagaaacgagttccttcttcgatagcgattgtagagataagttcaacgatcatttcagtgttatctccaggcataaccatttctacgccttctggaagattgatgataccagttacgtcagttgtacggaagtagaactgaggacggtagttagagaagaatggagtatgacgtccaccctcttctttagaaagaacgtaaacttcagctttgaatttgctgtgtggagtgattgtacctggtttagcaagtacttgtccacgttggatgtcttcacgagctacaccgcgaagaagtgcaccgatgttgtctccagcttcagcgtagtcaagaagcttacggaacatttcaacacctgtaacagttgttttgctgttttcttcttgaagaccgatgatttcaacttcgtcaccgactttaacttgtccgcgttctacacggccagtagcaactgtaccacgaccagtgattgagaatacgtcctcaactggcatcatgaatggtttttcagtgtcgcgttctggagttgggatgtactcatcaactgcagccataagttcaagaattttttcttcgtactcagcatcgccttcaagagctttaagagcagaacctttaacaactggtacatcatcaccagggaagtcgtattcgctaagaagatcgcgaacttccatttcaacaagctcaagaagctcttcgtcgtctaccatgtcgcatttgttaaggaatactacgatgtatggtacaccaacgtttttagaaagaaggatgtgctcacgagtttgtggcattgggccatcagcagcagatactacaaggatagctccgtccatttgcgcagcaccagtgatcatgtttttaacatagtcagcgtgtcctgggcagtcaacgtgtgcatagtgacgagtgtcagtttcgtactcaacgtgtgcagtagagattgtgataccgcgctcacgttcttctggagcaccatcaatttgatcgtacgccatagctgtacctttaccagatttcttatgaagtactgttgagatagcagcagttaatgttgttttaccatggtcaacgtgtccaattgtaccgatattggcatgtgatttggaacggtcgaatttttctttagccattctaaaatcctccttaagagcttttaattagtaatgtatagagtgatagaaagtgaaagcaagctctcacttcctcatcttacaatagtagttatacttgagttaagtggcaaaatcaattattcgcctttattttttttgataatttcttcagcgatgctcttcggcacttcttcgtagtgatccatgaacattgtgaacgtaccgcgtccttgcgtgttagaacgaagggcagtagcgtaaccgaacatttcagcaagaggtaccatcgcacgcacaacttgagcgttaccgcgagcttccataccttctacgcgtccgcgacgagaagtaacatcacccatgatgtctcccatgtattcttcaggaataacaacttcaactttcatgattggttcaagaagaactgggttacatttgctgactgcatttttcaatgccatagaagcagcgactttaaacgccatttcgtttgagtcaacatcatggtaagatccatcaaaaagtttcgccttgatgtcgattagcgggaatccggctaggacaccattttcaagagagtcttcaagacctgcttgtacggctgggatgtattcacgaggaacaacaccaccgacgattgcgttttcgaattcaaagccagcgccttcttcgttcggttcaaattcgatccaaacgtgaccgaactgaccgcgtccgcctgattgacgtacgaatttaccttcaacttttgcaccggtacggaatgtctcacggtacgcaacttgaggagcaccaacgttagcttcaactttgaactcacgcttcatacgatcaacaatgatatcaaggtgaagctcacccataccagagatgattgtttgacccgtttcagggttagtttgtgtacggaatgtaggatcttcttcagcaagtttcgctaaagcgatacccattttatcttggtcagcttttgatttaggctcaatcgctacgtcgataacaggctctgggaattccattgattcaaggattacaagatccttttcatcacacagagtatctccagtagaagtatcttttagacctacagcagctgcgatgtctccagcgtaaacagtagagatctcttcacggctgttagcgtgcatttgaaggatacgtcctacgcgctcacgcttgccttttgtagagttctttacatatgaaccggaatcaagtgtaccggaatatacgcggaagaatgtcagcttaccgacataagggtcagtcataactttaaatgcaagtgcagagaacggctcttcatcagaagaatgacgaacgatctcttcatctgtatcaggacgaacacctttgattgcagcaacatcagttggcgcaggaaggtagtcaagaacagcatcaagtacaagctgaacacctttgtttttgaaagcagaaccaacaagtacagggtagaattcaacattcagtgtacctttacggatagcagctttcagttcagggatagtgatttcttcaccttcaaggtacttttccataagctcttcatcaagctcagctacagcttcaatcaggctgctgcgaagctcttcagcttgctctttgtactcttcagggatttctttcgcatctgaacgagttccaaggtcatcttcgtagaaatacgcaacgttttctactaagtcgatgataccttcgaagttgtcttcagcgccgatcggcaattgaattgcgtgagcgttagcttgaagacggtctcttaaagtgcctacagagtaaaggaagtctgcgccgattttgtccattttgttgacaaatacaacgcgcggtactccgtaagttgttgcttggcgccatactgtttctgtctgaggctcaacacctgattgagcatcaagtacggcaaccgcaccatcaagtacacggagtgaacgttcaacttcaactgtgaagtctacgtgtcccggtgtatcgatgatgtttacacggtaacctttccactgtgcagtcgttgctgcagaagtgattgtgataccgcgctcttgttcctgctccatccagtccatttgcgaagcaccttcgtgagtttcgccaattttgtggatacggcctgtgtagaacaagatccgttctgtagtagtcgttttaccggcatcgatgtgagccatgatcccgatattacgagttttttctaaggagaactctcttgccattgggtaatttctccttccttattagggaattattattttgattatatgaatcctaccagcggtagtgagcaaatgctttgttcgcttctgccatcttgtgagtgtcttcacgtttcttaacggcagcaccagtgttgttagctgcatcaagaatttcgttagccaggcgctcttccattgttttttctccgcgaagacgcgcatagttaaccaaccagcgaagaccaagagttgtacggcgttcaggacgaacttctacaggcacttggtagttagctccacctacacggcgtgcttttacttcaagtacaggcatgatgtttttcaatgcttgttcgaaaacctccattgcatcattgccagtgcgttctttaatgatatcgaatgacttgtataggattgtttgagatttaccttttttaccgtcgatcatcattttgttgatcaggcgggataccagcttagagttgtaaagcggatcaggtaaaacatctctttttgctacaggacctttacgtggcatctgaatatcctcccttcatagttttaatgatttattattattactttgctttaggacgtttcgtaccgtatttagaacggccttgcgcacggttttcaactccggcagtatcaagcgcgccacgaacgatgtggtagcgtacccccggtaagtcttttacacgtccgccgcggatcagtacaacgctgtgctcttgcaggttgtgaccgataccaggaatgtaggcagtaacctcgattccgttagtcaaacgaacacgagcatatttacgaagtgctgagttcggttttttcggtgtcattgtaccgacacgagtacataccccgcgtttttgtggagaagatacgttagtgtgctcttttttaaagctgttgtatcctttgtttagtgcaggtgacttagagttttcaactttgctcacgcgtcccttgcgaattagctgattaattgtaggcatgttgtgttcctcccttcattacgttttataacccacatacccaggtggttcatcattaggcaaaaaaacaatgtctttacataagattgatatcttatataaaaacaaaaagtacgctataacataatggcaacagctgctgctcccacttcaattccgcaggctttgccgagctttttcatggaatccaccatacagacagcggtattttggttctttgcaagctggataacgccagccgtaagaactgaatccgcgtcttttgccacgacgacttccttcactgaacctcgttttagagctttcactgtttgcttcgtaccaataataattgatttggcctgtgatactttatcataagacataaacatatcctccaaagtaacaggttttatttcgagcaccttggttatattatcactctgcgggacggatgtcaacaacgtatgacattttttagtgcagtcccccgccagaataattgtaatactgaggaaaagctgtcgaaacagcctttcctgcagcagtttctgttattcagccggaaccatatcttccgaaggctgaacgtttgaaacaggttttacttttctgtaattcatcatacctgtaccggccggaaccagtttaccgatgatgacattctctttcaggccgagaagttcatcacgcttgcctttaatcgcagcatctgtaagaacgcgtgttgtttcctggaatgatgcggcagacaagaatgaatccgtctcaagtgaagctttcgtgataccgagaaggacaggacggcctgtagcaggtcgattgccttcaagcagcacttttttgttcgcttctgtaaattggtgaatatcaagcaatgtgccagggagaacatcagtatctccggcatcgattacacggactttgcgaagcatctggcgaaccattacttctacgtgtttatcgccgatttcaaccccctgcatacggtaaaccttctgaacctcatgcagaagatattcctgaaccgttgtcaggtcagtaactttaagaagttctttcggatcgattgaaccttccgtcagcacttgaccgcgggtaatctgatcaccctcagtcactttcaggcgtgagttgtaaggtgccgtgtatgaacgggtctcaacagcaccctgaacaacaatctcctgctgtttgtcgcggacttcattgatttcggcaattgtaccgtcaatctcagaaatcgtcgcttgacctttcggattacgcgcttcgaaaagctcctggatacgcggaagaccttgtgtgatatcgtctccggcaaccccgcctgtgtggaacgtacgcatcgttaactgtgttccaggctcaccgatagattgagcggcgataatacctactgcttcgccgacttcaacatcagttccggttgcaaggtttcgtccgtagcatcgtttacatacaccatgaggagtgttacatgtgaacgcagaacggatccacacttcttcgattccggcttcaacgatttccagcgctttatcttcatcgatcaattcattttcgttaatgagcacagcacccgtttcaggatgtttgatctgttttctggcgaaacgtccgatcagacgctcttccagacgctcgatgatttccgtgccttctttgagcggttttgcaagaataccgcggtctgttccgcaatctgtttcacgaatgataacatcctgcgcaacatcaacaagacggcgtgtaaggtaacctgagtcagctgttttcagggcggtatcggcaagacctttacgcgcaccgtgagtggagataaagtactccaatactgtcagaccttcacggaaacttgatttaatcggcaattcaatgattcgtccagccgggttggccatcagaccgcgcatacccgcaagctgtgtaaagttagatgcgttaccacgggctcctgaatcactcatcatgtagatcgggttgacttcgtctaatgatttcatcagtttgccttggataacatctttcgctgaactccaaattgaaatgactctttcataacgttcttcttcggtgattaaaccgcgtctgaactgtttcagaacattatctactttgctttgtgcttcttcaaggatttcctgtttatcatcgagaacgacgatatcagaaacccctactgtgatgccggctttcgttgaatatctgaaaccgaggtttttcatgcggtcaagcattttagacgtttccgtgatatggaatcgtttaaagatttccgcgatgattttacccaaaataccttttttaaacggtgcgttgatcggctgctcagcaatcacagcttttacgtcagcacctttatctaagaagaaacggtcaggtgtcttctcttcaatgttgctcttcgttggttcattcatgtaagggaatgattccggaagaatttcattgaagacgagcttaccgacagttgtaattaacaattttgaacgctgttcttcagtaaatgtcacattcttaagggagttcgctgcaacagctactctcgtatgaagatgaacataaccgttttgataagcaagaagcgcttcgtccgtatttttgaaaaccataccctcgccgactgctccggcgcgctcaagcgtcaggtagtagtttcctaataccatatcctgagacggcgtaacaaccggtttaccatctttagggttcaagatgttttgggccgcaagcatcagaatgcgcgcctcagcttgagcctcagctgataaaggtacgtgaaccgccatttggtcaccgtcaaagtcagcgttataagctgtacatactaacgggtgaagacggatggcgcgtccttcaacaagcgtcggttcgaaagcctggatacctaatctgtgaagagtaggggcacggttcagtaagaccggatgctccttaatgacagattcaagtacatcccatacttcaggctgcacgcgttcgattttgcgttttgcgctcttgatattgtgagcaaggcctttttcaacaagctctttcatgacgaaaggcttgaagagctcaagcgccatttccttcggcaaaccgcactgatacattttcagatgcggacctacgacgataacggaacggcctgagtagtctacacgtttaccgagaaggttctgacggaaacgcccttgtttccctttcagcatgtgagaaagagatttaagcggacggttacccggtccggtaaccggacggccgcggcgtccgttgtcaatcagagcgtcgactgcttcctgaagcatacgtttttcgttctgaacgatgatgcttggcgcgccgaggtctaacagacgttttaaacggttattacggttgatgacacgacggtaaaggtcgttcaggtcagacgttgcgaaacgtccgccgtcaagctgaaccatcggtcttaattcaggcggaataaccggaagcacgtcgagaatcatccaagacggcttgtttcctgaattacggaaggcttcaagcacttcaaggcgtttgatcgcgcgtgtacggcgctgtccttgagaagtcttcagctcttcttttaacatatcaacttctttgacaaggtcgatgtcctgcagaagtttattaatggcttccgcacccatagaggcttggaatttgtttccgtacttatccagatacgcacggtattccttttcagataaaagctgtttcttttcgagcggtgtattggccgggtcagttacgacgtaagaagcaaagtaaataacttcttccagcgcacgcggtgacatatccaatacaagacccatacggctcggaatacctttgaaataccaaatgtgagaaaccggggcagccagttcaatatgccccattctctcacgacggactttagcccgcgttacttcaactccgcaacggtcacaaactacgcctttataacgaacccgcttgtacttgccgcaatgacattcccagtccttagtcggtccgaaaatgcgttcgcagaacaggccgtccttttcaggtttcaacgtacgatagtttatcgtttcaggctttttcacttcaccaaaagaccatgaacggattttatccggtgaagcaagaccgatgttcatatactcaaaattgttcacatctagcaaggggcctacctccctttttatcttcggattaaccgatgtcacttgcctttatcaatcagagactattctttcgttactgcgtcacgttcaacgtctggagatgctgtttcttccggcgcttcatcacctgataatgcaaggccgtcagcctgtttcgcatcttcctcgtcttctagatctctcatttctatttcttcttcatcgcctgagaggatttttacgtccatacctaagctttgaagctctttgatcaatactttgaatgattccggaacaccaggctctggaacattgtcgcctttgacgatggcttcatatgttttcacacgtccgaccacgtcatcggacttcacagtcaggatttcttgaagcgtgtaagctgcgccgtaagcttcaagcgcccaaacctccatctcaccgaaacgctgtccgccgaattgggctttaccgccgagaggctgctgcgtaacaagtgagtaaggacctgtagaacgggcatgaagtttatcgtcaaccatgtgagccagtttgatcatgtacatgattccgactgatacacggttgtcgaacggttctcccgtacggccgtcataaagaactgttttagcgtctcttgacatgcctgcttcttcaagtgtttcccacacatcttcttcacgcgcgccgtcaaatacaggtgacgcgatgtgaatgccgaggtagcgggcagccatacccatgtgaagttctaatacctgaccgatattcatacgtgatggtacacccagcgggttaagcatgatatcgatcggcgtgccgtcaggaaggtaaggcatatcttcttcaggaagaatcttcgagataacccctttatttccgtgacgtccggccattttatcaccttcagaaatcttacgtttctgaacgatatatacgcgtacaagctggttcactcccggaggaagttcgtcgccgtcttcacggttgaagacttttacgtcgtggataattccgccgccgccgtgaggcacacggagagaagtatcacggacttcacgcgctttttctccaaagatcgcatgaagaaggcgttcttcagccgtaagctcagttacacctttaggcgttactttacctacgagaaggtctccgtcgttgacttccgcgccgatacggataattccgcggtcatcaaggttgcgaagcgcgtcttcccctacgtttggaatatcgcgggtgatctcttccggcccaagctttgtatcacgtgcttctgattcatattcttcaatgtgaatagatgtgtatacatcatctttcacaaggcgttcactcatgatgatggcatcctcatagttgtaaccgtcccatgtcatgaagccgaccattacgttgcggccgagagcaagttcaccaagctccattgaaggtccgtcagcaaggatttctcctttgactacttcatcgccgacacttacaatcggacgctggttgtagcacgtaccttggttggagcggacaaatttcagcaagctgtacttatccaggttgccttttactttttggccgtcaatttcttcatagcggcgcacccatacgtttttcgcttccacccgttctacgataccagggtgtttacaaataacggctgcaccggagtctttaccggatacgtattccatacccgttccgacgatcggagcttccggctgcatcaaaggcacagcctgacgctgcatgttcgctcccatgagggcgcggttcgagtcatcgttttccaagaacggaatacatgctgtcgcagcagaaacaacctgtttaggagatacgtccatgtaatccacgcggttgcgggctacaacggtgttttcccctctgaaacgcgctacgatgctgtcatccaagaaagaaccgtcatcgctcagcttagcattcgcttgggctacgacatagttatcctcttcatcagcagtcaggtagtcgattctaggcgttacttttcctgtttcaggatcaacgcggcggtatggcgtctcaatgaaaccaaagcggtttactttcgcaaatgatgacaatgagttgatcaaaccgatgttcgggccctcaggcgtttcaatcggacacatacggccgtagtgagagtagtgaacgtcacgtacttccatacctgcgcgctcacgcgtcaaaccgcccggtccgagagctgacagacggcgtttgtgcgtcaattcagcaagcgggttcgtctgatccatgaattgagaaagctgtgagcttccgaagaactctttaatagacgcaataacaggtctgatgttaatcagctgctgcggcgtaattgtattcgtgtcttgaatagacattctttcacgtacgacacgttccatccggcttaaaccgatacggaattggttttgcaggagctcacctacagaacgcagacggcggtttccgagatggtcgatatcatcagtgtcgcccactccgtgcaggaggttgaagaagtagctgatagaagaaataatatcagcaggcgtaatgtttttaatcgcctcttcgatgtaagcattgccgatcacattgatcgtctgctctccttctgcatcagtaggagcatagattttaatggattgaagcatcacttcatcctcgacaacgccgccgttaggataaagttttctgaagccgattccattttctaagtatggcaatactttatcaagtgttcttctgtcaagaatctgccctttttcagcgagaatttcaccggtttccggatccaccagtgtttctgcaaggcgctggttaaacaggcggttcttgatatgaagctttttattaattttatagcgtcctacattcgcaaggtcgtatcgcttcggatcgaagaaacgggaatccagcaagctttttgcgttttctactgtaggcggctctccgggacgaaggcgctcatagatttcaagaagcgctttgtcactgttttcggtgttgtccttatccagtgtattgcggagatattcgttctcaccaatgagatcgagaatctcttggtcggaaccgaagccgagagcacgcaaaagaaccgtaaccggcaacttacgtgtgcgatcaatgcggacatacacaacatctttcgcatcagtttcgtattctaaccatgcgccacggtttggaatgacagtcgcggtaaaaccttttttaccgtttttgtctactttaccactgaaatatacacttggagaccgaacaagctgagatacgataacacgttctgcaccgttgatgataaaagtaccggtatctgtcataatagggaaatcacccatgaagacatcctggtcttttacctctccagtttctttgttaattaaacgaaccttcactcttagcggagctgagtaagtcacatcacgttcttttgactcttcaacgggatacttaggatctcctaaactgtagtcaatgaactctagagagaggttaccagtgaaatcctcaattggtgatatgtcttgaaacatctctctaagaccctcatcaagaaaccactgataagaagaggtttgaatttcaatgagatttggtaattctaacacttcgctaatgcgagcatagcttctgcgctggcggtgtcgtccatactgaactagttgacctgtcaactgattcacccctcaaatcatgcgtattatatgtgtaataagcatctcttacgataaagaaatacttttacaagacaaaagaaaaaagggtttctaattaagaaaaccacatccaaaaacaaataccgattttattagcatttccatgtttgtataatttatacatgcactatgattatttgagcatatcatgcaaaatatatacattggcattttacaatattaacatagctgaaaattcaagtcaaactttttttgcttttatgatataatagcctttctttttttgaaccacagaaacttcgtcaaaaagctccttcagtttttcaatggcagaaggcccgccctgttttttctgtataacgatccacaattcacctgaagcccttaaatgctcagcgcttttttcaaaaatggcatggacaactttttttccggcgcggattggggggtttgtaataatagaagcaaatgtttgagcagaatcaatatttgaaaataaatcactctgataaatccgaacgttttttattccgtttttttctgcattttcatttgacagctctacggctctttcattcacgtcaatcatgtgcacggtccggtctgtaaatgcaccggcgagcgacagaccgatcgggccgtaaccgcagcctgcatccaggaagtcaccatcgatctccggctcttcaaacgcttcaattaagacacgcgaaccgaaatcaacttcctttttcgagaaaacgccgctgtcacttgtgaatgtataagatctgttccgcagtgtaaatgaccatgtctgtttatcgcttttaactgaaggtttttctgaataatagtgttcactcattattagaacctccttttttaattgcacttaaagaaaagcaaagaaaaagcccgcctcataaaagcgagcttcccctacaggcaagtgaagattacttaacttctacagaagcgccaacttcttcaagtttagctttaagctcttcagcttcttctttcgcaataccttctttaagtggttttggagtgttgtcaacaagttctttagcttctttcaagccaagaccagtgatttcacgaacaactttgataactttgattttctgagaacctgcaccagcaaggataaggtcgaattcgctttgctcttcagcagcgccgccagcagcagctccgccagctacagctacaggagcagcagcagttacgccaaattcttcttcgattgcttttactaggtcgttcaattcaagtacagttgcttctttaacggaagcaatgatttcttcgatatttaaagccatttgaaattcctccatttgttttattttagggtaaaatcagattaagcgccttgttcttccttttggtctgcaactgctttagctgcaagtgcaaggttgcgaactggagcttgaagtacgctaagcaacatagaaagtaagccatcgcgtgaaggaagttcagcaagagctttcacttcttcaacagaagatacttttccttcgataacgcccgctttgatttccagagcttcgtgatttttcgcgaactcgttaagaacttttgccggagcgacaacatcttcagtactgaatgcgatcgcattcggtccagttaagacatcattcaaaccatcaagttcagcttgttcaaccgcacggcgagtcattgtgtttttgtacactttgaactctacgttagcttcgcgaagctgtttacggagttcagttacttcagaaacgttaagtccgcggtagtcaacgatgatcgttgatttgctttctttcagtttagaagcaatctcttcaacaacaactttttttgtatcaattgcgctgctcatggttacacctcctgtagattttgtgtaacacttataccgctaggtgatcacgactgtgacgacgatttcatataaaaagcctccatgtggacatggaggctgtatatacaagcatacgtaacgtaatagctgtgatatatatacacctcggcaggatattaagcctcaacggcccctgctgtctacggtataaatgacatattatattttacaacattttgaatcatatcagaatgctgatctaaagtcaaatattattttacgttgaaagtagaagcgtctactttgacaccagggcccatagtagaagtaacggcaacgtttttcacgtaaacacctttagccgcagccggttttgctttcaggattgtatcatacattgttgtgaagttctcaacaagtttttcatcctcgaaagaaacttttccgatcggaacatggatgttaccagctttgtcaacgcggtattctactttaccagctttgatttcgccgattgctttttctacttcgaatgtaacagttcctgttttagggtttggcataagaccttttggtccaagcacacggccgattttaccgacttcacccatcatgtcaggagtcgcaacgattacatcgaattcgaaccagccttgctggattttcgcgatgtaatcagaatcaccgacgtagtctgcaccggcagcttcagcttcttttgctttttcgcctttagcgaatacaagcacgcgctgagttttaccagttccgttaggaagtacaactgcaccgcggatttgctgatcgtttttacgagggtcaacccctaaacgaaaagcaacttcaactgtagcgtcgaatttagctgtgtttgtttttttagtaagcgccactgcttcagcgacgtcgtaagctttcgcacggtctacaagcttcgcagcttcaacgtactttttaccttttttagccattttaaaatttcctccttatgtggttatagcggaataacctcccacgaataagggttgcgaacttgtgaaaactcgcaacccgacaagaaacaaattaatcctcgataacgatacccatactgcgggcagtaccttcaaccatgcgcattgccgcttcaacgtctgctgcgtttaagtcaggcattttcgtttcagcgatttcgcgaaccttatcgcgcttaacggttgccactttattacggtttggttcaccagaaccagactcaattccagctgcttttttaagcaatactgcagcaggcggagtttttgtaataaatgtaaatgaacggtcttcgtaaaccgaaatttcaacaggaatgattaaaccagcttggtcagctgtacgagcgttaaactccttacagaatcccatgatatttacaccggcttgacctagtgcaggtccaactggcggcgctgggttagcttttccagcaggaatttgcaattttacaacttttactacttttttagccacgagacacacctccttaagtccgtgatgtggtaatagggtaaaccctcccactcaaggtttcattctttatatgaatgacgaaatatcaagctagctgccttggattagtccaagacgtacctttgctatattatcattaatatatagcaatttcaagttttttcacattacaatttgtcgatctgggtaaattccagctcaaccggcgtttcacggccgaacatgttaacgaatactttcactttgctcttatcataatcaatctcttcaattgatcctgtaaagttggcgaaaggtccgtctatgactttgactgtctcattcaattcaaaatcaatgtcggttttccgctcatccatgcccatccgctttaagatggtttccgcttcgccaggaagaagcggagtcggctttgagcctgaaccggctgatccgacgaatccggtaacgcccggcgtgttgcggaccacataccaggaatcatcagtcatgacgatttcaacaagcacataacccgggaacactttctttttgactacttttttcttgccgttcttaatatcagtctcttcctcttcagggacgacaacgcggaaaattttatcctgcattcccattgattccacacgtttttcaaggttcgcttttactttgttttcataaccggaatacgtatgaacaacataccaattcttttccattctatcaggactctgcagtccttccctccccgcatttaaaaatgaagtgtaaaacaaaaaataggctcagagcctatgaatccttttttcaacacaataaaaaacccgctgaacgggttttggcaaacgatattatgatctattatagcacgtattgctgatcattattcaactattaaacgaattaattgagaaattcctgtatcaaggagggcaaaaaagataacaaaaaagataaccgttgaaatcaccgtgatcgtatagcgcgttaactctttgcctttaggccagctaacctttttcatttctttcccaacatctttaaagaaactcatcatgcgcatgtaaaagacctccacaatttaaaaagcgaacactattttgtttctaaatgagctgtatgtgaattgcaagtgctgcagtacttcttaacttctaaccgctcagccgctgatgcagagcttttcattgtcgtataattacgatttccgcatgttttgcatgccagcgtaatcttttttctcatgtcgttacaccttttcctaaacaatcatttatcttaataaaatagcacagtcagaaaaattctgtcaatatgacacagaaacccgctacagactgatttctcttatttccaaatacttttcaagcttgcgcttcacgcgctgcagggcattatcgattgattttacgtgtcggtttaaatcatctgaaatttcctggtaacttcttccgtccaagtacagaacaagcacctttctctccagatcgctcagcagttctcccattttcatttcgatatcatcaaattcttcctgattaataatcatctcttcaggatttaacgttttagcgcctgaaatgacatcaagcagtgttctgtcagattcttcatcaaaaataggtttgtctaaagaaacataggaatttaaaggaatgtgtttctgacgggtagctgtctttattgcggtaataatctggcgggtaatgcataattctgcaaaagctttaaatgaagtaagcttgtcctctctaaagtctcggatagacttatataagcctatcatcccttcctgtacaatatcttctctgtcggcccctattaaaaaataagaccttgctttcgcccgtacaaaattacggtacttcgtaatcaagtaatctaacgcatcactatccccaacatgaaccttttcaatgacctgctcgtcctccaactggcaaaattgcactttgttgaactttcccttgctgttctgtagattcactgcgatccccccggcgcacgtagatagaaatattatacattaatgggcgaaaaagcgtcaacctaatccagaccgcctcggcgccacttttcaaacgttttcaaaacctcttcggacagctcgattttacccggtggtttttcagaagtgatctttgaaacccgcctttgaatccgccgttctatcgtatccacttccctcagaagctcccgggcggatttgcggagagccccttgtccgaaaatcgcccactgctccgtataatcggaggttgcgacatgaatctgtgtcgcaatattattcagcgcctgggcaagtttctcgatccgctcatccgccgtctcattctcccgtgtaaaaatcacttcgactctgtgattcgtttgttttttctctatgccttttaccagatgtgcgtcaaacaccacaatgactctgattcccgtgtaggactgatattccgccatcttctggatcagtacatctctcgcttcttcaaaactgttcgcttttaaatcctttagctgcggccaagctccaatcatgttgtatccgtctactaacaggatgtccatctgtcattattcccctaaaggattgcgcttccggtagacttcatacatgagaaggccggccgctaccgacgcattcagagacgtgacttttccggccatcggaagtttaatgagaaaatcacatttctctttcacaagccggcccattcctctgccttcgcttccgataacgagcgccaaaggcatcttgccgtccatagagcggtagtcttcccgggcggatgcatccgttccgacgacccaaatcccccgctccttcatttcatcaagtgtccgggcaaggttggtcaccttcacgacgggaatgtgttcaatcgcaccggtcgaagcttttgcgaccgtcgatgtcagtccgaccgctctgcgtttcggaatcacaatgccgtgtgcaccgacagcgtcagccgttctcatgatggaaccgagattatgagggtcttccagctcgtccaatatgagaaagaaaggctgttcgtttctctcttccgctcttttatataattcgtctaattgtgcatattcatatgccgccacctgggcgacaacaccctgatgctgcccctccaccatctgatcgagttttttcctcggtacaaattgaatggtgacgccgcgctttttagcaagctccataacttgctgcgcctgtccttttactgtgttttccgccatccataacttatacagcttgcgatctgactttaacgtctcaatcacagcgttttttcctatgacgtaatcatgttgctgactcatttgttttcctccctgacgtcccgacttgtatagcctcagcaatcagctgattcagtctttcttctcttttctcaagaaaaaggtatccgagtaaagcctcaaaagctgtactatggcggtacgtctgtacatctgtgtttttaggcgtggtccctgatttcgcgtttctgcctcttctcagcacggcttcctcttcctccgtgaaaaaggattcgtcctgaaggcggaacaatatgtctgcctgtgattttgccgatacaatccggctcgccttcttatgaaggtcattcggtttcgtaaagccctgcttaagcaggtgatgccggacgtatatttcaaaaatggcatcacccatataagcaagcgcaagaccgtttaactgctttgaatctttgatttgttcaaattgaagcatccgcttattctccccgcttccagcgagttccctgggctgtgtcttcaagaatgatattcatgcttttcagctgatcgcgaatctggtctgacaaagcgaaatcgcgattgcggcgggcttcatttctcttctcaatcaactcttcaatctcttcgtcgacaagctcttcttcgccgagcgtaagtccgagaacagatccgattctgtcaaacatgctgataaaggctttaatgacgtgatccgccgtattgtcttcctgcatgtagtaattggcgagcttcgccagatcaaaccaaacggaaatcgcattcgccgtattaaaatcatcatccattgcttcttcaaacgaagcgcggtgctcttcgattttagcgagccattcctcatcattgtcagtcagattcgtgctgctaatcaaacgatggtttaaattactgtatgccgtcttgaggcggttaaacgcgttttttgttttctcaagcagctcttccgaatagttgatcgggtggcggtaatgaacggaaagcatgaaaaatctcaaaagctgcgggtcatattgcttaatgatatcgtgcaccaaaacaaagttgccgagcgattttgacattttctcattatcgatattgatatatccgttgtgaagccagtattttgcgaatgtcttgcctgttaatgcttcagattgcgcgatttcgttttcatggtgcgggaatgtcaggtcctgaccgccggcgtgaatatcgatttcgtcacccaaatactttttcaccattgcggagcattcaatatgccagcccgggcggccttttccccaagggctatcccatgaaatttctccgtccttagcagctttccaaagcgcaaagtccagcgcatcctctttcttctcgccgacacggatacgcgcgcctgatctgagttcatcaattgattgctgagatagcttgccgtagccttcgaaggcccttgttttgaaatagacgtcgccttctgattcataagcgtagccttttttaatcagctcgctgacaaattcaataatggcgtccatgttttccatgacccgggggtgaagatccgctttccggcatccgagggcgcccacgtcttcaaaatacgctttaatgaaccgttcagaaacggtcgggacgtcctcgccgagctcgttggccgctttaatcagtttgtcgtcaacatcggtgaaattcgatacgtattgaacatcgtatcctttatactccaaatagttgcgtacggtatcatacacaatcgccggacgagcgtttccgatatgaatatagttgtatacagtaggtccgcacacgtacatttttactttgccttcctcaagaggaacaaatgtttcctttttccgtgtcaatgtattataaagtgtaatggtcatttttggttgatcctttcttttttatcttccagttcagcctgcagttcaaaaatctgctgctccaatgctctaaaccggtcagcaaccggatcgggcaagtcttggtgattgagatcgcgtttgatttttcttccgttctgaatgacgactttccccggtatgccgacaacggtcgaaaagtcgggaacatcacgaagcacaacggagccggcccctactttagaaccctgcccgaccgtaatagagccgagcaccttcgctccggttgcaattaaagcatcatcttttatggtcggatgccgcttccccttttcttttcccgttcccccgagagtgacaccttggaataccgtcacgttattgccgatttcacatgtttcccctatgacgacccccataccgtggtcaatgaaaaaccttctcccgatggtcgcgccgggatggatttcaattccggtaaagaaacgggcaatctgtgatatcaggcgcgccaggaagaaaaatctccgtttatataaagcatgtgcaatccgatgcgcccatatagcatgtaaaccagaataagttaaaacaacttcgaaatagcttcttgctgccggatcttgatcgaacactgtatctatgtcttcttttagcattttaaaaaacacatgcttccccccattctctccccgctccagtctgtttttccgcctataaaaaaagcgcctctgcatgtaaacatgacagagacgcttttaccgcgcggttccactctgtttgaaaaacaagtcaatgttttcccaacttaaaagccggtaacggcggcggccgcctttaaatactgatttccgcagaaatgttcttcaaaggtcttaagggcgcacttctaaaacatgacgcatgaatctctctcagccgatgaagattctttctgtaatggtcattgttttatactcttccctgtcaacaatcgtatatttaaatgcttttcaggcgtctgacggctgtttctctgccgatcagctcaatggcctgcggaagctccggaccgtgtgtctgaccggtaaccgctacacgaatcggcatgaacagctttttgcctttatggcctgtttctttctgaacagctttgattgaggctttgatcagctcaggcgtaaattcttcaagctcttcaagcttcgcagcaaatacgctgagcacttcaggcacctgttcttcttccagaacggcttttgcctcttgattatactcgatctcatctttaaagaacaaatcagtaagctcgacaatttcagcgccgtagctcaattgctcatggtaaagagagattaatttacgaacccattcctgttcttcggcagaaagctcagtgccgacttttcctgctttttgcaggtgcggcagggtcagctcaaccacttgatcaagatccagcgctttgacgtattggttgttgacccatttcagtttatgcatatcaaacagagccggtgacttagacaaacgatttacatcaaaaatttcaatgaattgttctcttgtgaaaagctcttcttcaccgacgggagaccagccgagaagtccgataaagttaaacagcgcttcaggcaggtaacccagctcatcatactgctcaataaactggataattgattcatcacgtttacttaattttttgcggctttcgtttacgataagcgtcatatgtccgaagacaggaatatcccagccgaatgcctggaaaatcatgatctgtttcggtgtatttgaaatgtgatcctcaccgcggagcacgtgcgtcattttcattaagtaatcgtcaatcgcgacggcaaagttatacgtcggtgttccgtcttttttgacgatgacaaagtcgccgatgccgtctgattcaaaagaaatctcgccttttacgatatcgttaaatgcgatgattttcccttccggcacgcggaaacggatgctcggctgtctgccttcggctaaaaactgctcctgctcttcctgagtcaggtttctgtgtttgccggaatagcgcggcatttccccgcgggcgatttgctcttcacgttctttttcaagttcttcttccgtacagaaacatttataagcaagccctttttcaagaagctcttcatagtactctttgtaaatgtcgttacgctcagactggcggtacgggccgtattctccgccgacatccacactttcatcccagtccatgccgagccatttcaaatagttaagctgactttgctctccgccttcaatatttcgctttttgtccgtatcctcaatccggataataaactttccgccttggctgcgggcaaataaatagttaaaaagcgccgttctggcgttaccgatatgcaaatgtccggtcggactcggtgcataacgaacgcgtacttcatttcccatgttcaaatacttcctttcatctcgtctgtagcctctagccgaatatatgtatctattctaccaccaaatagacccggcatcaaaacaatgatcaggctttttgaatcagaacggttgcctgagcggcaattccttcggctcttccggtaaacccgagcttttcagtcgtcgtcgcttttacgtttacttgagagacgtccgcctcaaggccttccgctatccgttttctcatagcatcaatatgcggcgccattttcggcttttgcgcaataatcgtgcagtctatatttccgagtacgtaccctttttcttttacaatgttccagacatgctgaagcagcttaaaagaatcagcatccttgaattccggatcagtatccgggaaatgcttgccgatatctccttcacctgccgctccgagacacgcgtctgcgactgtatgcagcaatacatcagcatctgaatgtccgagcagtcccttttcataaggaatttcaattccgccgatgatgagcggacggccttccgttaattgatgcacatcaaatccttgtccgattctaaacattatgattcccactttccgctttcatgattgcttccgcaaatatcaggtcatccggcgttgtcagcttaatattggtatagctgccttcaacgatactcacctgatatccatcaagacgctcgacgaggctggcgtcatccgtacctaagaagcctttgttttccgcttccatatgcgccgtcttcaataaagaaagacgaaaagcttgcggcgtttgaacggcccacaagcttgaacgatcaaaggtctccgcagcccgggagccttccgcccgttttatcgtgtctttcacaggaacagccaggacagccgctcccgcctcctctgctgtttcaacgagcttatcgatatgctgatgtgtgacaaacgggcgcgctccgtcatgaacaagcacgaccgattccttatcaatcactttcagtccttcgtatacactgtgctgacgctccgcacctccggtaacaagctcaatttccgtctgaatcggaaattggaccagcagctggcgaaaatcttcccgttcactctcgtttatcaccaggattattttctgacagggtgcgtggctttcaaaaacccgcagtgtgtgtataataacgggcgcaccttttaagctgatgaacagcttatttttcccggccttcatccgttttccttgtccggcagccggaataacgacaacatactccatatgaactccctcttaaagagctttctcaagcagcttgggcttggcaaaaatcattcgtcccgccgctgtctgcagtacgctggttacgagcacatcaatatgtttccctatataattgcggccttcttccacaacaatcattgtgccgtcatctaagtaagccacaccttgattatgctctttcccgtccttaatcacctgcacattcatctcttcgcccggaagcacaaccggcttcaccgcgtttgcaaggtcattaatattcagtaccgcaaccttttgaagctcgcatactttatttaaattaaaatcattcgtcacaacgacaccggatgtcagcttcgcaagtttgacaagcttgctgtcaacctcctgaatgtcttcgaagtcgccttcataaatttcaaccgtaatatccagttccttttgaatgcgattcaagatatccagtccgcggcgtcctctgttacgttttaaaacatctgaagaatcagcgatatgctgtaattcctccagcacaaattgaggaatgacaatgacgccttctaaaaagcccgtctgacaaatatctgcaattctcccatcaataataacacttgtatccaagattttcagccttttatcctgttcttcctgctcctcatcagcacttccctttttcttctgcattcttgcagaaatggagaaaagactgatcagttcatcctttttcttaaatccgacttggaagcccagataaccgagaaagaaagccagaaagaccggaatgatggtgctgaatatacggtacggaatattgtccagcggaatcacgtttacaatgagatatgcgatgataagtccaaaaaccaatccgagactcccgaataacagatccggcaccggagctctcagcaaagaatcttcaatccattttacccaattaatcacatattctgtcgtccatatactgatgagaaaaaagataatagcaccaattgcagcagacgtatatgcgtttgttattaaaggtatgtcctgtatatttgacagcacaaacaattcaggtattaaaaagataccgacaacgccgcccacaataatgaagaacgcctgaactattcgttttaacatacctccacctccttttaagtagcattttttcagcagactgtcagagcctacaaattcagaataaacaaaaactaacaataatatacccggattccgacaggtttaagcgatacttaaagctgtctatctatatagtgtttttcctgaaggcgttttaagccttttttgattttttgggcgcgcacttcgccgataccctcgacatcatcaagctcttctacagtggcttccgttatgctgggcaaaaatccgaacgcctcaaccacattttcaacaatcggcatcggcagacgcggaattttgttcagcagcctgtagcctctcgggagcacataatcatcaagattcgtagaagccgggtatccaagcagtttaaacagaatggaatcatccagcagatcatagctggacatatcctggagctcttttaacagcacgaacggatctttgattttttctttgacatagtctttgatgaaaagtgccgcctcttcttccatgtccgtaatcagttcaatcacctgcagacggattaagtgtccttccgttccgagttctttaatatacatattgatttcattttttattcggagcaccatttcataccgatgcatgacagacagcacgtcactgaatgtcacaagctcctcaaactctaatgcgtttagagccgtaattgttttgtctaaaatggttttatacttctcgagcgtttgaatggcctgatttgcctttgttaaaataaaacctatgtcctttagtgtgtacttcatgctgtcctgatataacgtaatgacatttctgcgctcagaaatggcgatgacgagacagccggtctgcttcgccacccgttccgccgtacggtgcctcattcccgtttctgaagaagaaatggtcgcctccggcataagctgtgtattcgcataaagaattttctggccggaatcacttaaaataatggcaccgtccattttggccagctcgtataagtgagcgggcgcaaatgatgtattaatatgaaaaccgccatcgacgacttgctttaccttatcattgtatccgacaacaatcaggccgcctgtatttgcccgaagtacattctctatcccggctctgagcggggtgcccggtgcaacgaactgcagaattgcagacaggtcaagctcttgtttcgccccttttttctctttttccatctattatgatcctcctaatgaagtacgaagcgcttctgcaacatttgctactccgacaacctcaatcccttttggtattgtccacccatctgcattcgcctcaggtatgatcatgcgcttgaagccgagtttcgccgcttcttttacgcgctgttcgattcttgacaccctgcggacttctcctgtcagtcccacttcaccgataaagcaatctgcgggattcggcggtgtatctctgaagcttgaggcaatgctgacggctactgccaaatcaatcgccggttcatccagtttgaccccgccggcgacttttaaatatgcatcttgattttgaagcaaaagacccacccgcttctcaagcacagccataattaacgataccctgttgtggtcaatgcctgtagccatgcggcgcgggtttccaaaactggtcggtgatatgagcgcctggatttcaaccagaatcggtctcgttccttccattgacgcaacgatactcgaacccgatgccccggcagaacgctcttccaagaaaatttcagaagggttgagcacttccgtaagcccctcttcccgcatttcaaagatgcccatttcatttgttgagccgaaacggttttttacggcccgcaaaatacggaatgtatgatgccgctctccttcaaagtatagaacggtatcgaccatgtgctcaagcaatctcggccctgcgatcgatccttcttttgtgacgtgtccgacgataaaaataggtatgccgtttgttttcgcgattttcatcaattcggccgtacactctcttacttgtgatacactgccgggagctgaggtgatatcactttggtaaacggtctgaatggagtctacgacaacaaatgcgggtttcatctcttgtatagcagacgaaatatactccatatcggtttcagataaaacatgtaacatttggctgttgatgccaagtctgtcggcgcgcagcttcgtttgcttcacggattcttcccctgaaatgtaaagcacgctgccggccgtatctgctaattgtgcggatacttggagaaggagcgttgattttccgatcccgggatcgccgccgatcaatactaacgagcctttcacaacgccgccgccaagcactctgttgaattcttcgagctttgtttgaacgcggggttcttctgatgtttcaattgatgtaatgggtgatggtttctggacggtttgaacggagtgggagaaagccgcccgccgattcgccggcgctttttttatggtttcttccaccattgtattccaagccccgcagcccgggcactttcccatccattttgcggattcataaccgcatgagtggcagatgaattttgtttttgatttagccatatatgttgtaagacctcttccttatcgaatatttctctatataacaaagtgaggcatacactcgcttacgtatgcctcatgtttgtcactatattagttcgttttagcagttgtttttacgacaaattcgccgtcctcaacatcaagaacaatgtgttggcctttatcaatattgcctctgaggagttcttctgataaccggtcctccacatgcttttgaatcgctcttcttaacggacgtgcgccgtattccaaatcgacgccctcttctgctacttttgctttggcagcatccgtcagctcgatagagagatcttgttctttcagacgttttgttaactgatcagacataagcgacacgatgtctgtaagatgttttttctcaagggagtggaagacgataatttcgtcaatccggttgataaactcaggtctgaaggcacgcttcaactctcccatgactttgtctttcatgtctttatggttttgtgattcatcctggacattgaagcctacatatttgttgcgcttcagctcgctcgccccgacgtttgacgtcataatcaggatcgtgttgcggaaatccacagtgcgtccttttgaatcagtcaagcgtccgtcttcaagcacttgcaggagaatgttaaacacatcagggtgtgctttttcaatttcatcaagcaatacgacagagtaaggttttcttctcactttttctgtcagctggccgccttcatcatagccgacatatcccggaggagaaccgacaagacgtgaagtcgagtgtttctccatgtattcggacatatccactctgatcatcgcttcctcatcaccgaaaatggattccgccagcgctcttgccagctctgtcttcccaacgcctgtagggcctaagaagatgaatgaaccaatcggacgtttcgggtccttcagtccggctcttgcacgtctgacagcctttgccacggctacaacggcttcatcctggccgatgacgcgggaatgcagaatgctttccatattgagaagcttatctgtttccgtttgggcaattttagatacgggcaccccggtccagctggatacaaccatcgcgatatcctctacagaaacttcggagttctcctggccttgtttttctttccaggtttttttcgtgtcttccacctgttctctcaggcgctgctccgtatcacgaagggaagccgctttttcaaactcctggctctgaacggcagcgtctttttccttgcgaacttcatcgagtttctgctcaagctcttttaagttcggaggcgttgtgaaagaacggagacgcacttttgaaccggcttcatcaattaaatcgatcgctttatccggaaggaagcggtcagaaatataacggtcggacaatttaaccgcggcttcgatcgcttcatcggtaatggatacgcggtgatgcgcttcatagcggtcacggagcccttttaaaatttgaatgctttcatcggctgacggctgatccacctgaatcggctggaaacggcgctcgagagccgcgtctttttcgatatatttacggtattcatcaagcgttgtggcaccgatgcattgaagctctccgcgggccagtgaaggttttaaaatattcgatgcgtcaatcgcaccttctgctcccccgctccgatcagtgtatgcagttcgtcaatgaataaaataatattgccggcctgacgtatttcatccattacttttttcaagcggtcttcaaattctccgcggtatttcgtaccggctacaaccgtacccatgtctaacgtcattacgcgtttatcacgtaaaatttccggcacttcattattgatgatctgctgtgcgaggccttcagcaatcgcagttttacctacacccggttctccgataagaacgggattatttttcgttctgcggcttaatacctcaataacacgctgaatttctttgcttcgcccgataaccggatcaagactgtcttccttcgcaatcgcagttaaatcacgcgccagactgtcaagcgtcggcgtgtttgcattgctgttggtaccggatgcagaagaccccgtctcattgcttcccagaagctgcagcacttgctgtctcgctttatttaagctgacaccgagattattcagaactctcgccgccacgccttctccttcacggatcaatccgagaagtatgtgttctgttcccacataagaatgtcctagctttctggcttcatccatgctgagctcaatgactttttttgctcttggcgtataatgaatcgtttgagacatttcctgtccccgtccgattaagctctccacttctttctgaattttatccgaaccgagtccgagtgcttggagtgctttagccgcaatcccttctccttcacgaaccagacctaataagatatgttcagttccaatattgttatggcctaagcgcagtgcttcctcctgtgccagtgccaataccttttgagctcgctctgtaaaccttccaaacatcatatcgaatcatcctcctgtctatttgcactcatttctaaatgcagcctttccctgataagcgccgctcttctcgcgtctctttcgttcggccgtaatgcaccgcccgaatattgctggagaaaacccggctgtgtcaaaatcatcagttcattaagtatattgcttgatagccctttgatgatcccaaggtctatccccagccgaacgtcagaaaggcatttcgccgtttcctttgattcaatcatacggcagttggataaaacgccgtaagatctgaatacccggtcctccaattcaattttcgaagtttggtaaagcgcttctcgggctgaacgttcctgctcaatcagctgggcagccacactgtttaaatcatctacaatgtcctgttctgattttccgagtgtgatttgatttgaaatttgaaagatatttcctaatgcttcgctgccttcaccgtaaattcctctaacaactaagcctaattggttaattgccggtataattcgattcatttgcctagttaatacaagacccggcaaatgcatcatgactgaagcccttagtcccgtccctacatttgtaggacagcttgttaagtaccctctcttctctccaaaggcgtaatccactttctcctcaatccagtcatcaacctggtttgccgcttttatggcgttgagaagctggaagccggggaagaggcattgaattctgatatgatcttcttcatttaacataatgctgacttcttcattttcagaaagcagacagccgccaaaaggagattccgttaaattcgggctgatcagatgtttctccatcagcacccgtttttccaaaggctgagcttcactcattctgattaaatgaaattgaccgatatcaggcagttccttacctgaaaaatgatcttcgaattgctgaatgatggatgaggcttcttcattcgtataccgggcgggaaactttatattttcaaagtttcgggccaaccgtatacggctgctgagtacaatgtcactttcaggtcccttttgcttcatccaattgcttagtgcgtcctgaataaaatgcttgagcgacattacccttgttcccctcactgtctgtactttttaattcctgctctaacgatcggatctgatccctgacctccgctgctctttcaaactcttcgtggtgtattaaagattcaagttctttttttaacatttccatttgccgtcttacatgcaggtttccgcctattcgttttggaattttcccggcatgcaccgtattcccgctgtgaacttttcgcaagatcggcgtaatttggctgtagaacgtatcgtaacattccgcacagccgaaacgccctgtttttctcagctgctgaaacgtcataccgcatttcttacaagctgtgccttgctctgagtagccgaacatttgagaaccggtgttttgaaatgaggactccatattcagcagtcctgataataaattatgaattgagaacccttggtttccacttatactgtatgaatcgctattttcttttgcacattgttcacaaatatgaacttcttgcttttctccattaacaactttcgtaaagtgaaaagtggccggtctctcattgcattcttgacaaatcaatcttttcacccgcttactttagttttaaagatgtgagcattgctttcatcattctggctcttagttcatcccgttcgggcaaatcaatatatagaactgaacgatccattacactcaccatcattttagcttctctttccgaaataactccgtcctctaacagtctgagaataatgtcatcagaggctgcctgggacaagtgggtatggatctgcgaaataatattattgatgaggacgacttcgttattcattttaattttgataatacgaatataaccgccgcctccccgtttactttcaacaatatatcctctttcacttgtaaatctggtgttgatgacataatttatttgggaaggaacacattgaaatttatcagcgatttcactgcgtttgatctctaaaatttctttgccattttgatctaatacttgtttcaagtactgttcaatgatgtcagaaatattatgtcccactcaaccccctcctttattgactttgactatatttgactttaatcttactataaggtgtttcgcaaaatttttcaactgtatcgctctatctctattatttccactttacacaagcataaaacctgcttttgcaaaaagccatatcgttacttttctcatactatataacgtatgcagaaaaacacaaaaaaggcagctcatgatgagctgcctttaccgtaaatatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccatctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattacaattgaatgtgaattacttctgttatctagttttcaaagaacaacatctcgaagaatcgaatgatccttcaaaactaaacaagacagggaacgtactgtttataagacccgaggtctaatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattttgttcactttctcaagcaactttttaagtatataataagtttctcttaaagtcaacatgtttttttataaatggtggagcctagcgggatcgaaccgctgacctcctgcgtgcaaagcaggcgctctcccagctgagctaaggccccgaagtggtcgggaagacaggattcgaacctgcgaccccatggtcccaaaccatgtgctctaccaagctgagctacttcccgatttttaaaaatattatggcgcgcccgagaggagtcgaacccctaaccttttgatccgtagtcaaacgctctatccaattgagctacgggcgcataataatgaatgccgagggccggacttgaaccggcacggtagtcacctaccgcaggattttaagtcctgtgtgtctgccaattccaccaccccggcgtggatggtatagttggagcggaagacgggattcgaacccgcgacccccaccttggcaaggtggtgttctaccactgaactacttccgcatacaggataactatcctgtataatgcgggtgaagggacttgaacccccacgtcataagacactagatcctaagtctagcgcgtctgccaattccgccacacccgcgttacatggtgagccatgaaggactcgaaccttcgaccctctgattaaaagtcagatgctctaccaactgagctaatggctctttttaaaagacttgtgttattatcttgtccaaaaatggtgccggccagaggacttgaacccccaacctactgattacaagtcagttgctctaccaattgagctaggccggcaaatatggtggaggatgacgggctcgaaccgccgaccctctgcttgtaaggcagatgctctcccagctgagctaatcctccatatattacacttacgtgtaatggcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtcccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcaggaaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacaatatctcgaagaatcgaatgatccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctcctaaaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgtcacctcaccaactagctaatgcgccgcgggtccatctgtaagtggtagccgaagccaccttttatgtctgaaccatgcggttcagacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagatcattttgtctttcgttcaagcgactttattattatatcttatcaatctcttgaagtcaacaactttttaaatttctttttttcgtcagcgccttgtttagcggcaacgaataataatataccacctcacaaataatagtgcaatagtttttttaaagaaaatcaaaaagttttacgagcggcttgtttctaaaaaagcgccgtactgcgataagcagaaaacggcgccttcccttttattagcgttgtctcatttgagggaataataaaacgtctctgatagacggagcatttgttaacagcatgacaaggcggtcgataccgatacccaatcccccggtcggcggcatgccgtattcaagagcttcaacgaagtcttcatccatcatatgcgcttcatcgtttccttcttctctttcttttaattgcgcttcaaagcgttccctctggtcaatagggtcattcagctccgtaaacgcattagcgtgctcacggccgacgataaacagctcaaaacggtctgtaaagcgagggtcctccggatttttcttagcaagaggagaaatctctacagggtggccgtaaataaatgtaggctgaatgagtgtttcttcaattttttgttcgaagaattcattgatgatatgacccaccgtcatagagtttgtgatctcgataccatgctcttttgcatgaccgcgcgcttcttcaacagtcatctcattccagaaatctacgcctgtcgcttctttgaccgcatctaccatgtggagtcgtttccactcaggtttcagatcaatctgctcttcgccgtactggattgtggtgcttccaagcacttcctgcgcaatatgtgctacgaggttttccgtaagactcataatatctttataatcggcgtacgcttcatacagctcgatcatcgtgaattcagggttatggcgtgtagaaacaccttcgttacggaacacgcggccgatttcgtagactttttccaatccgccgacaatcaggcgtttcaggtgcagttcaatcgcaatacgcatataaagaggcatgtcgagcgcgttatggtgcgtgatgaacgggcgtgcagacgctcctcccggtatgctgtgcatcgtaggtgtttcaacttctaagtatccatggtcatctaagtatcttctcatcgcttggatgattttgctgcgtgtgataaacgtttgtttgctgtcagggtttacgatgagatcgagatagcgctggcggtaacgctgttcaacgtcttttaacccatgatatttatcaggaagaggacgcagtgcttttgtcagcagttcaaaagatgtcgctttgacagaaagctcgcctacgtttgttttgaaaactttcccggtgatgccgataacgtctccgaggtctgaagatttaaagatttcatattgttcttcgccgacactgtcttttcttacgtaaatttgaatttgaccttctaagtcctgcagatgcgcaaagccggctttcccttttccgcgctttgtcatcatacggcctgcaatggtcacttcgatcgctttttcttccagttcttctttagaaagctcctggtaggcgtcaatgatttgttgagattgatgcgttctctcgaaacgttcgccgaaagggtcaatgccgttttctctcagctggttcattttatctcgtctgacttgcagctggtcgttcaattcctcatgattttgctcttcttgactcattggtatcactccgttacattttgatttcacgaaaaagcagaaaaactgccagcggtaagctggcagtgagcagcaatagagggtgtatattaacctacttttgcatcttgaagctcttttgcctctgcttcggcggtaaatgcatctaaaagctgcacaaatttttcacgcgtctcacattggttaatttcattgcgtacattcgcattgcctctgacacctttcagataccaggcagcgtgttttctcatttctctgactgccacattttcgccttttaacttaatcaggcggtctaagtgcagtttgcataccgacattttttcacggactttcggctcgtcttttaactcaccggtttcaaggtactgcaccgtacggtaaatcatccacgggttgccgagtgcggcccggccgatcatgacgccgtcaactcctgtttcctcaagcatgcgtttcgcgtcctgaggcgttttgacatcaccgtttccgatgacgggaatggagacggattgcttcacttctttaatgatatcccagttcgcagtgccttcatacatttgcactcttgtgcggccgtgaagggcaacggcttttccgccggcacgttcaacggcttgggcgtttttcaccgcataaatgtgatcttcatcccaacccattctcatcttcactgtaaccggcttatcaacagcatctactactgcggataccatttcataaatcttatcaggatcgagaagccatttggcgcccgcatcacattttgtaatctttggtacgggacatcccatgttaatatcaataatatcagcagtcgtgttttgatctacaaacttcgccgcttccacaagggtttccttttttcctccaaaaatctgaaggctgagcggtttttcacgttcatcaatgtaaagcatccccattgttcttgcgttgttgtaaaggatcgctttgtcactgaccatttcagcgcataccaatccggctccgaattcctttacagtcaatctgaacgctgagttgcagacaccggccataggggcaagcacaacccggtttttcaattgaatatcaccgattttaaacatttttcccctcctttcatttgtctatttttcaggcggggccaattcgtccgcacttatatttaaaacatctgccgcatcttgaatgatggcatctgacggcaatcggtttccgcgttcaatttcaccgacaatagaaactgatatacctaatgcttttgcaaatccttcttgagtataacctttcagctttctgaatgcacgaattcgcctaccccagatttctgcttccatactcttacaccttcttggtttgtttcagcgcttatcgtgatatgatccgcctgcggacatatttcttttaacggcgcaaggacaaataagcgctcatacattctcggatgcggaacaatcagccgctctgtttcaatattttcacgattatacagcaaaatgtcaaggtctgccgtccgcggtccccagcgaatctctctcgttctgcctaattcagcttcaatggactgtgttacatctagaagttcaaaaggagataacgacgttttcacttcaaccgccatattgagaaactgatcctgatcctcataaccgacgggatctgtttcatatatagaggatatctttgacaccgtcacgccatcatgccgggtgagcatggccactgcctggcgcaaataatgttcacggtcgcccatattggaaccgaggccgatatatgccgtattgttcatgatttctttctcgtcatttctatggctactgatttataatggccgggaatcggcgggtcaggcttaacaacctttaccgtacattgctgcaccggctcaaatttctcaaggacggtgtctgcgatccgttccgcaagggtctcgaccaaattaacgggctcgccctcaacgatgccgcggcagacactgtacaattccgcatagttaatggtataagaaaggtcatccgtttttcccgctttgctcaaatccagttcggcagtcaggtctactttgaagcgctggccgagtttgttttcttcctcgaacacgccgtgatatccgtaaaactccataccttccacatatactttatccataatgcgcgcctcctttgttcagcatagcatccatcatcttagtcattcttgcgatctctttaacatcgtgcaccctcacaatgtcgcagcctttttggacgccaaggcatactgtcgctcccgttccctcggcacgttcttcagggggaaggtcaagcacacggccgatgaacctttttctcgatgtcgccaggagcagcggataccctaacccgctgaacacctccagcttgttcatgacagccagattgtcctcatagtttttcgcaaagccgatccccggatccagaatcatgttttcatctgtgacgccggcttctgcggcaatttttacgctttccatcaagtctgcaagcatatcaggaataagatcgttatagtttctttccatacgattatgcattaagataatcggaactccgtgtgcggcggctactgacgccatgtcagggtcacctttcgcccccagatgtcattaaggatagaggctcccgctttgaccgcttcgtctgccacggacgctttgtacgtatcgattgaaagcggaatgtccagctcgcttgtaatccgttctatgacggggatgactcgtgacatttcctcatcagccgaaacgagtgatgcgccgggccttgtcgattcgccgccgatatctatgatatgcgccccttcttcagccatcttcgccgcatgcagaagcgccctttccgtactgtcgtatttgccgccgtcagagaaggagtctggcgttacatttaatatccccataacgagcgtcttctctttataggacagagcgcctttttttgtatgaatcagtttaggctgttcaattgtttgctgcgccattttgttcctcctcctgtacattcattttgtttatttcctgccgatactgcttacggagcaattgcaccgttttcccgctcattccgggcagcggcacttcctctattttagaaaacgggatgatttcaagcacggagtttgtcaaccatgcttcatccgcttcaagcattgattgaaaacggaatcggccttcggtgacttctgtcccctgccgtttcaattcatcaatgacaaactgtcttgttacaccgtcgagaattcccgtatccaaagatggcgtaaagaccttgtctccttttcgccaaaacacgttggagacaatgccttccgcgacatctccttctccggtcaggaaaatcccttcaagattgggatcattcccgatctcccgtttagcgtacatgttgtttaaatagtgatgggattttaaccggaaagatccttcaggcgtatttctccggacagagagaagcctgccttctttttgaacaggcagagtttccggattgagccggttcacgaaacaaaggacggtcggcttttcataagtctgcgcggcaaatcccttatcgctgacgcctgccgagatgttaagccggacacgcgcgctgccgtcctttatgtcattgagaagcaacagtctccgaagcatatcaagcagctcctgtttgttcacctcgaatgcaatctgcagatcccgaagcgccctgttgagcctggcgacatgcgcatccggcagaaacggccggccgctgtaaagcctgaacgtctcgaacgctccgatcccgtacagataaccatggtcaaaaggagaaagcgccgcttctttctcctctatatattgaccattcaaatatataatcacaccgatacttcctttttgcggtgtgtctctataaagtttctgagcatctctttgccgaaggaggtcatgatggattccggatggaactgaacaccttcaacaggcagctcattatggcggatggccataatttctccttctttggtttgagcggataccgtaaaacaatccggcagcgtgtccgctttgacaataagtgaatggtaccgggtggcgaccagcggattttgcaggccgttaaaaatcgtctgtccgtcatgcataacttctgacgttttgccgtgcatgagccgctctgctctgacgacatcgccgccgaatacttgcgcaatcgactgatgcccgagacatacgccgaaaataggaatactgccggcaaaatgtttgatggcttcgaggctgatccccgcttcatcaggactgcacggcccgggagaaatcattaagaagtccggacccagctcttcaatctgctcaatcgtaatctcgtcattccgtctgacgatcagttcctccccgagctcacccaaatattgaaccaagttgtacgtaaatgaatcataattgtcaatcattaaaatcatctctgctcacctcgtctgattttttgtctcttcttcgctcagctctaacgcctttttcatcgcaaaagcttttttgaacgattccttgtattcatgcttcggaaccgaatcaataaccactcctgctccggactgcataaaagcatgtccgccggctgcatagatcgtccggatcacaatgttaaactgcaaatctccgttgaatccgaaccagcctatagatccagtataaagcccccgtcttgtcggctcaagctcttctataatttccatcgttctcactttgggcgctcccgtgatggtgccccccgggaacaccgcatgaataatgtctgtcgcgtcatatccgtcctgcagctctccctgtacgtttgacacgatatgcatgacgtgggaatatttttcgatcgccataaactcgttaacccgcacggagccgtagcgcgatacgcgcccgaggtcattacgctcaagatcaacaagcatgacgtgttccgcacgttctttttcgttgtgaattaattcatcagccaaagccttgtcttcagcatcgtcttttcctcttgaacgcgtacccgcgatcggtctcgtttcaagcttcttccccttctttgtcaccaatagctccggcgacccgcatatcacttgaaaccccggtgtctcgagataggccatgtaaggagacggattgacgtttcgcaagtgtttatacacctcatacggatgaacggataaagactgagactgcctgatggacaaattaacctggaacacatccccgctcgcgatatattgtttaatttgttctacagcctgtgaaaatccttcctcggtgaacggagcggcgtacgatccgtccccattccgattcagcggtgaaaaaggctcgtccgccgtttggagggaacaccacatgtcctctaagccggacagcttttcttccgcaagatccgcttcttccgcttcagtatgggtaatgagccataacgcctcttcctcatggtcataaacggccacatcatcaaaaacaagaaagtaaatatcaggtgtttccagatcatctaacgacagcatcttaaaattctcaatatatcgggcatagtcgtaactgataaaaccaatcgcaccgccctgaaagtccggaaactcaacgtttgtttccgttccgagcgttccaaaccattcatgaaaggcccgcagcgggtcaccttctttaaacagtgtttctccctcatgcttgatcgttgtaattccgtctttccctctgacggacgcaatcggatctagaccggctatactgaatcttccccctctcgcgctttcgagcagaacatgccgttttctcgatttcgaaaggttttcatatcgctgtaaaaatgcttgtttcgtaaaaggtatttttcttcctgccggtctgcgttgtgccatcatatcaatcctctgcttcgttttactgtagttttattttaaagcaatcacactggtgaaaaaagtgaatttcacttccaaccataaaattcgaaacgttttttggattttcgatacttcaggcacaaaaaaactcccggatacagccgggagccgtgtgtatgtctctattcaaactgataaagcggtgtgcttaagtaacgttctccgttactagggatgatcgcaagcactttcttgcctttcccgagttttttcgcgatttccagtgccgcgtaaatggccgctccggaagaaataccgccgagaatcccttcttcttttgccgttttacgggcatattcaaatgcatcctcgtttttgacgggaatgatttgatcatagatgtccgtattcaatgtttcagggacaaatcccgctccgataccctgaattttatgcggacccggttttccgccggaaagaactggagaatccgccggctctaccgcatagattttgatggatggatatgcttttttcagcacttcgcccgctcccgtgatggttccgccggtaccgattccggccacgaacgcatcaagctggtcgtcaccaaactgttctacgatttctttccccgtcgtttggcggtgaatttccgggtttgccgcattgttgaattgctgaggcacaaagtatccgtgttcctccgcaagttcttccgcctttttaatggcgcccttcattccttctgcgccgggagtcagcacaagctccgctccgtatgcgcgcagcagattgcgtcgttccatactcattgtatcaggcataacgagaatggctctgagacctttagccgctgccaccatcgcaagaccgattcctgtatttccgcttgtcggttcaatgattgtgtcgccggcttttaattttccttctttttcagccgcttcaatcatcgccgctccgatacggtcttttacgctgctgcccggattcatgtattcaagcttcagatatacatctgcactgttttcatccgtcaggcgattcaatttcacaataggagtatttccgattagttcagtaatagaatttgcaatacgcaccatgttggacacctcaatttccgactaaatttattggtattataaatataagttatcaatttcaaaattttttgtcaatcatttagttcttttttccccgtagaaccaagagacccccgcctctttccacagcgttttgactgtcgccttgtcacctaattgatccatcgcgatctggcgtctgatttgactcttcacttcattgtatgagaaagttctcgctttaagcttttctttcagctgaatgacggcatatcctgaagaaactttaatcggttcagcggaccattcatcttctttgagatttttagcttctgtgatatatgcctgcgggatattttcctggttttctgtcacaaagccgaggtctccgccatactgagacgtgtatctgtccgtggaacgctcagcggcgacggcttcaaagctggaaccgcctttcaaatcagcaagcaccctgtccgcctcttccttgtttttgacgacaatgtgcctgattctgtaggaatcatcgaaatggtacagttctttatttttattataaaatgattgcatttccttatccgatatatcgatgtccttcgtcagcagttcttcaagaagaatgttgtagcggatctggtctctccattctttttcggtaatatggctgtcttcataaaatgaattattcaccgctttgattaaaagaaattcacgttccaattcggtgtttgaaactgtgagtttattctttttcgcaagttcttccactacttgtgcattaatcatatcctccagagttgattttccgtactcgtcttccatctttttcatccagtcctgccgtgtgatatgtttatcaccgattgtcgcgatggattcttcagatgaccccgcggcttgggattttgttaacttatacgccactgctacactgcataccaacagcgccgctacaataatcgtcaaaagtgttctcgatttcaaaatctaccccatcccttttacaaaatagaacaacccgctaaagagctagcgggttgtttcgtcacgaagctcttccagttcttcttttgtaaataaatatttctcattacaaaaatggcaaaccgcttcggcttttccgtcttcttctatcatatcttgtatttcttttttgcctagtcctaaaatggccgtttcgaatcgatcttttgaacaagaacagtgaaatttgaccggcattgtttcgagaacgtccggtttttgacccagaacttcttctaagatttcttccggtgtcaggcctttttgaatcaattttgaaatcggttcgatttgagataattgcttttcaattgttgaaatggtttcttcatcagtccccggaagaagctgaatgatgaacccgcccgcagcgagaatcgtgttatcaggatttactagtacacctaccccgacagatgaagggacttgttcagaagaaacaaggtaatacgtgaagtcatcaccgagttcacccgagacaatctctacttgccccgtaaaataatcacgcaagcccaaatcttttacgacactgagtgttccgtcagttccgaccgcccgtctgacatccagtttcccttgttcattgaggtcaaaatgaacgtgcgggtttgatacgtatgctcttacctcaccctttgcgttcgcatctgcgacaatggctccgatcgggccgccgccttctattttgactgtcagcttatcttcacccttaagcatcgctccgagcatcagagacgctgtcatcgtccggccgattgcggctgatgccgtcggccacgtgtcatgccttctttgcgcttcatttaccatatctgtcgttctggctgcataagcccgcactttaccgtcatatgcaattgctttaattaaataatccatcgtttacctcctatatgtgacccacgcgatttcgctcataaatgatttccagcccttttaaagtaagaaacgggtcaacaatatcaatacagtctgattcgtttgcgattaatgacgcaagcccccctgtcgcaatgactttcggttcttgtttggcctgccatttcatccgctttacaatgccttcaacttgtccgacatagccgaaaaggatgccggactgcatggcgcttaccgtgtttttgccgatgatattatccggtcgggcgatttcaattctcggaagcttggccgcgcgtgagtacagcgcttccgttgaaattgtaatgccgggagcaatcgcaccgcccatgtattgtttgttttcatcaatgtagcaatacgtcgtcgccgttccgaaatcaacaacaattaaggggccgccatactgctggatcgctgcaacggcattgacgatcctgtcagctcccacttctttcggattgtcatattttatatttaaacctgttttcattcccgggccgacaacctgcggctcgatgtgaaagtattttgtgcacattctttctaaagagaacataatcggcggcactacggatgagatgataatcccttcaatctgttcaaacatcagtccggaatgttcaaataaggagcggagcagcatgccgaattcgtcttctgttttgtgcctgctcgtttctatgcgccaatgatattctaattccccatcatgatatacaccaatcacggtgttggtgttccccacatctataaccagtaacaacctctatcaccacttttgaatagtttctaatcataacattttcaacattctacaataccatacacgatctgcggctcttttgtaaacaaaacggaaccagtaaaaaaaccgccggtatacgccggcggttttcatatcagaaagcgaactattctttcggctcgtctttcttttcgtcttctgttttagacaggatgtttactttcacatcgtctttttgaagatggtcatctgagaaattgcgctcagggagttttccgtgatccacgagatgcttgatttgttccgcatctaatgtttccacatcaagcaatgtctgagcaatcaattcaagcttatcgcgattttcagtcaggatggttttcgcacgctcataacattctttaatgatgcgctgaatttcctgatcaatttcgtaagcgatctgatcactgtagttttgctcgttgttgaaatcccggcccaggaatacttgaccgccttgagattgaccgaactgaagcggtccgagtttttctgacataccgaactctgtcaccattcttctggcaatgttcgttgcccgctggaagtcattgtgagcccccgtgctgacttcgccgaagataatttcctcggcaacacgtccgcccagaagaccgacaattttatcgagaagttcaggttttgtctggaagtaacggtcttctctcggaagcatgactgcgtatccgcctgcctgccccctcggaacaatcgttactttatgaaccatatcggcttcatccagcacaagtccgataacggtgtgaccgccctcgtggtacgccacgatattgcgttcttttttcgagatgacgcggctcttcttcgcaggacccgcaatgacacggtccgttgcttcatcaatgtcgcgcatatcaattttcttcttgttttgacgggcagcaacgagtgccgcttcgttaagaaggttttctaaatctgcgcctgagaaaccgggtgttcttgaagcgattgcttttaagttcaccgtctcatcaagcggtttgtttctcgcatgcacctgcaatacggcttcacggccgatgacatccggacggtctaccgtaatctgacggtcaaaacgtcccggacggagcaatgcagggtcaagaatgtccgcacggtttgtcgcagcgataataatgattccttcattcgcactgaaaccgtccatctcaacaagcagctggttcagcgtctgttcgcgttcatcatgcccgccgccaagaccggcgccgcgctgacgtcctaccgcgtcgatctcatcaatgaagatcaggcaaggcgcattctttttcgcattttcgaataaatcacgcacacgggaagcaccgacaccgacaaacatttcaacgaagtcagatccgctgatgctgaagaaaggaacgccagcttcaccggctgaggctctcgcaagcaatgtcttaccggttcccggaggtccgacaagcagcacgcctttagggatcctggcgccaagctcggcgaatttgcggggatctttcagaaactcaacaacctcaacgagctcctgcttctcctcatccgcgccggctacatctttaaacttcacgcgtttcttttcttccgtatacagcttcgctttgctctttccgaagttcatgacacggctgccgccgccctgagcctgattgagcaggaagaaaaacagaataaagatgatgacaaacggaatgatcgtcgttaagaacgtcacccacccgcttgtttcctgtgcgggatcaacttttacgtccgtctttttaattgcgtcaaatatctggtctgctccttttccttcaggaacatgtgttaaaaagtactggtctttgtcgtattttttcagctgtccttttacctcataaacacctctgacaggctgaaccgatacgctatcaactttcccttcatcgaggttcttgataaacgtactgtacgacatattttctgttttcgggtttgaggtctggaagtaactcacaaccccgattactactaataaaataagtaaataaaaaatggtattacggaagacccgattcattccttacctcctcccacagtaagcacaactatgttcaatagtaccatagaaaatcattccaatacaaccgataaccatctcggaagcaggcagccgatcagctttcataaatcgccggttttaatactccgatgtaaggcagattgcgatagcgctcggcataatcaagtccgtaacccacaacaaacgcgtcaggaacttcaaagcctacgaagtctgctttaatgtccgcttttcttccgcttggtttatccaacagggtaacaatcttaattgatttcgctttacgatatcggaagagttctacgagatagctcaaggttaacccactgtcgataatatcttcaatgattaagatgtcccggccttctacagatgtatccaaatctttgatgattttgacttctccggaagaaaccgtggaatttccgtagcttgatacatccatgaagtccatttccaaatatgtatcaatatgctttataagatcagccataaaaggaagcgctccctttaacacaccgattgccaacggaaacgtgtcgctgtactcgcttgttaattgttctccaagctgttttactttctgctggatctcatcttctgagatcagcactttttcgatatcctgtttcatgttaatgcttgccccctacacttttcatgctgtctatattgtaatacaatgcggtcactgtttgaaatcacaagatcgtcaaagatggattttttcaagccaggcagccagataatttcaccgctcgcatccgttacaatcggccattcgtcccgatcccgcagaggcagtttatgatcaataaatatatcttttacctttttcgagccattcatccctttaagtttaatccggtcgccgatttttctcgtccggattgttaaaggaaattgcaccttatttctgcttgtcataaaaacagcattcccatttttgatatgagggtcagcctgatcggccacctctatcataaagccgttggggagaacagcagtctcgccttccgctccttgcagctgcagctcaaagggaaccttttcacattgccattgttcaaatgtaaacaaacatgtctgatatgatttgaccaccttcagccctttcggaaaatcaagcactcccgaggcgcttccattttccgcccattccagaaactgctgtatgtggcgggcggaaaacgacgatggaacgttttcataaagatagtttaatattagttgaactcctcttctttgtaaaggtatcggaagggcaagcaattgagaggaatcgacttcaaccgatgtgtcagacttgcttgtaataaccttattcattcgttctttcgttaatgactgcaagtattgttcgtcttctgtcagtgcttcactcaccttttgaaacattttatgaacgtcaggtgattcttgttttaaaaaaggaagcacggtctttctgaatctgtttcttgtataatcgtcttttgcattgctctcatccgttctgtagctgagcccttcttgacggcagtattctaggatttcatccttttccgcatagaggaaaggcctgatcagccagccggatgcaaattcgcggacgggctgcattcccgcgagccctgcgccgagcgtacctttcgcaagcctcatgagcattgtctcaacctggtcatcgccgtgatgagccagcgccaaaaacttcgcttggtgttttgtcatcagatcttcgaaaaactgatatctgcaatcacgcgcggcagcctgcttgttcagcttattcttctttgcgtatgcagaaacatcaatctgtaccgtttcgcagaggatgtgttccgcttcgcaatatgactgcacaaacttcatatcttcttcagattcaggacccctgaactgatggtcgacatgcgccgctatgataacggaagaatgcccgaagtgcttattcagcatactgagaagcgccattgaatcagggcctccggagaccccggcaataatcgtttctccctccgcctgaagatgatatgttttgaaaaaatcttccacgcttttcacaatgtcccctcacaatgagcaggtttttttaaagatatacatatcctatcactttcattccctccaagcaaagaagaagcatgagcgcaggcgtccggccggcattagatgagaaaaaagacgatgtaagcgaaataaagggcgagaacgctgattaaaataagcgttgtttcaaacaaaccattgtgctttgcgggtttttgtttaggtttataccgcgtttgagatacagtgccctgccgcggttttgattgcggcggcttaggcttggcggcggctttccttttactcccggcgctctgccccgccgtcaggatgtcatgcttcatggcttccgcagacggatattggccgtttaaagcagaaaacagaaccttcttatacttattcagaaacgggtggccttcaatgatagaacgaagctgttctttcggctgtcctgactttttgcactctttcttctggacacagtggatcatgatcattgcgacagcaaacaggtcataggatggttctgcttttcttgttccatacccccaatagccctgtcgtaaaactccgtatactctttaatcgcgcggccttgttttgtcgttccccctacatcaatgcagcggatggcagccggcggtccggttacaataagattttccggtttgaggtcgccaaaaacccatccctgctgatgaaggactgacaagctggaaagaagctgcaccatcagcaccggaatccactccgctcccttactgctgatatattgcggaagaagcggcccttctatgtactccatcacgtaaaaagagacatttttattcagctgcggaataaacgcatcgtccgcatcaaaaaaagaaggccccatcgtttgcgaccgggcctttgaaaaggattttaagacattcacttcagaggtaacagacatgctgtcgctgcttattttcaaagcgacctgtccgcctgatgcttctgccagatatacaataccgttagccccttttccaagctgtttgagcaatctgtaggatttgccgttccatttgccctgaattgccgtccccggtgccagactacatgccaaactcgttaaagcgtcgttcatcatctgccaacatgctccttcttgagcggattctctcaaactgctgcgtcgcttcccggatagcggggcccgtaggggtgataccgccggtcgacagcttcgcaaagagcgcagaaagggattcaagcttcggcgtccaattcagcacaagctcaacttcctggcttttcccgggaaatatacacatggcaaattcattttgtccggcccgggaatttaaactgatggaaagatcaatcagcgcttctttcaccgtcggcagtttcggcgccatactcgcactcgtatcaaccagcacaagcacctgcagatgaactgtttctccgagttcatcaaccacttccatcacttcgccgcgtttttccggagaaagctcttccatttcaacgtttttccctaagatttgtttaagctcttgattgacgacaccttgcagcgtctgggtcattgcttttttcgtcaccatttgaaccgtctgagacaattgtgacgcatatacaacttgatggacgccgccaccggccatggcgatgccttcaacttccttcattgcctcttggtcaatcgcgttttcttccataatccctataacattcaccgtaatcccctgctccttggcgaaagccgccattgcaatcgggtcttcaccatgattggagcagccatctgtaatcagcagaacttgatttaaatgtcccttattcacatacattcctcccggtgatacgattagtcccatcttcgccagaaggaaagtgatttatacgaaaggattaagaaatctcctttttattttggaataccgccggcaccggtatggaagcccatttcggcgtgttgtgatcaatccggacaacaaccaccgtcatatcgtcttcgatttggccggaacgcgttctgatgacctcttccattaatatatcagcgatttcctgcggatcttcggttttcagccctttcattttccgtttcatccacaggtcgtggttttcaacgtgcttcggtccttcaaaaataccgtcactcatcatgacgagcagatctcccgcttttaactgttcacttacaacctccacatcaaattcattgatgataccgatcggcagattgctggcctgcactttcatgacttgatctccccgcttgataaaactcggcgttgaaccgacctttaagaatttgcagcttgcatcctgaagatcaatgatagaaagatcgagagttgagtagatttcgtctgtcgtccgtaaagacagaatactgttgatcgttttgatcgctattttttcatcaatacctgattcgagaattttttcgagcagcttaatcgtttcgttgctctcataatgagccctcgccccattgcccatgccgtcactgattgcggccgcatattttctcgcccccagttccatcatgctgtagctgtcgccggagacaaggccgccgccttttgccgcatgagccgcgcctgtcgatacccggtacgatttggtcgaaccgaacgcaacatggctgtagccattcggatgagccgagtgctgttcgcttttgacaagtatctgctcctcaagaatgtcagacagcatcggggcgataattttctcactctcgccgtgtcctccgctgaacgggattgtcatttcgatatcaatattgccctgctccaagctgtatatctcgacatgctgaatctcgattccgaaatgctgaagcgcctctatcatttgttcttcctgaataaaatgctgctccctctcccgttttatttcccgagaaaagtccgccataacctcagaaacccccaacagctgctcggcaacaagcctcctgctgtcctgaacttttctcttcagtgtcagatgggcgtgatggtgggcaagttcgtcctcaatcagctcttccacctgtctggatttggaacagtgctgttgaaactcttttttcaatctgcggtttgaggcatactgcttttcttctgtttcatgcataacttgtttcattaagtcatatgttttatcaaagttttgaacccagcatttgctttttttatagcaggattggcaggaatgctcggtgattttgcttaaaaagagatccacttccccttcttccgcctgctcatcggaagacgtctgatgaaaggtggcgaagctctccgacaaggcatgaaacacattggagaactggtctactttctgggcggtgacatctctgattttcctcgcgtactgctgctgctcctgactgtgctcagcagtgcccggtatgtatcgcgccacctttttcgtaatcgattggggcgtaatcaaaaacaatacaacggcaatcaaagattcataaagagtggtcattaatccggcagacccttcaccatataatgaaatcagcagtgagccgatcaccaatccgactgcggcgccggctttctttccttctttcagcagcccgccaagaagcccggaaaacgcaagcagactcatttgatagagattcccgatattcgcaagcccgaggatcagtccggtcacaacaccgaccgtacagccgatgcttgccccgccgacaaaggaaaaactcagcacgacatagcgggccaggatatgttcagcctgcattccctgaaatgaaacaccggcaagcccggttaaaacggatgcgatcaagatcataaaacagatgatttcttctatttttaacgattgcttcacttttttgatcgtgaaaatcggcaggctttgtaaaaagatcagcgtcaaaataaaggccaggcccgcctcgacaacagccatcacataatcataggtggtaaaagcgccgctttcaaaataaacaaatccgattctcgcggcagccatagagaaaaacaccacgatcggcagcatcttcacccggtcctgcacgatatatgtaccgatttttgaaaatagagtgaagacggccaaagctgtgagaatcaataaagagtgtttcggcgaaatggttaaagcgcccgcaagtaaagacagacaagcatagaaggctttatctcttctgatcaaaagcatcgctccgaaaaacggcagtgcaaatggaagaacctcagataatatgaaagcccgtccaagtaaaaaaccgatcacgacataaatgaaacccttatagaaaaaaagtgaatgcgcttgatggactgtaagctttgccgccttttcaaaaaacgattgcagtttttccagagcttgtcccgccatcggcccgttcactcttctttccgctttttccattgctctcatcccccacctgttttattcgttgcttgtcattataaatgaaagcccagataggattttgtcaaaagaaggtaacaattccaaagaactcttcgacgctttctcccttgttcccctttccttttgtatttcctccgacatttctcaaaaagttgtctaaatatgaaaaaatcggcttctgcaacagaagccgattcgcttgatgacccgtacgggattcgaacccgtgttaccgccgtgaaagggcggtgtcttaaccgcttgaccaacgggccagatatatatggtagcggcggaggggatcgaacccccgacctcacgggtatgaaccgtacgctctagccagctgagctacaccgccatataggtgcttataagcacaagttatataatacaaaggtttcttcattccgtcaacagaaactttaaagttttaattttctgactacatgcgcgtatacaaaaaaagcacccgctgggatagacggatgctccatgtatttatagaaagcagcaagttatcctcttcttgctccgcgccctccacgttttgattccgtgtttcgttttaaagatgataagcggtcttcgctatctttaagaaacttgttcattttctgttcaaaagattctttcggacggaaatcatttctaggtctggcttgcggacggtctttagcttttttaattgataaaccaattttcccgtctttttcaacgttgatgactttcacttcaacttgatcgccgacttttaaatgctcgttaatgtcttttacataattatcggctacctcactgatatgaacgagaccggttgagcctccaggcaattcaacaaatgctccgaaatttgtaatacctgttattttcccttgcaacttgctgccaacttcaatcgacataaaaaaagtgctcctccttaggcttataaaaagatcgtttgtttaattatacctaaataaaaatttaagtgtcaacaaggctacttgctcttcttttctacattaaagagaatctcaccatttcctgacataaacaagtctcttctggcaagctctgtgacgtaatcctcatcctttaatttggaaatttcatcttttaaatcagcctgtttcgcattcaattctttaacttgtttttccagctgagcctttttttcttcgtttgcgctaagggaagaggtctgtgaccacagagaacccgctaagacaatagccgtcaacaacacaagggcgccgaatacgatcaaccgtctgaaaagccctttccgccttcttttcataagctgggattgccgttcaacctgctctttatagtcgttttgaatttcagttattgtacgttccctagatagattcaaaccagacggtcctcctttcaccttttcaaaatacgtatcatggtcgatctgattgttatgattagtttcttgctcttttgtaaaaatcctgcacttttttgaaaatatcgtttgaaagtaagacgccacttttcaggaagaagtttcaataattgtttcaacaggaaaaacagcggatacagcaaaaacgctacgatcttaaaaagacacttcgcaaaaaaggcactcacccgataggagtataaagaaataaccgtgatcagcccgatgagcagcttaaagagcagaagcaccggacggaacagcacgtgctgaatgagcttttttgcgaattggtaaagagacaccgcaagatgaatggcaaatttcagtatttttatatacattcgtttaaacaggctttggtacgtcgcaatacccagtaagacagccaagaaaatgtataccctgagttccccttcattcacgttgagcagcacatagaaaaacagcagaccttgtacaatccaaaagagaatgtcatgaatgaataacagccatctggccgttttggcgcggctgacaaacagcctgtatgtatcaagcgacgctccgagccaggcgcccataccggtcattgccagcatcgtataaaattgggtcgtcagcgtcatttaaacaacttgctaaaaaaccctttagctttatccccttgctgctcgtctaaatatacaaggtcaaacaccctgccttttatagatacaatccctttttccacatcaaggtttttcatctgcagattctcgcctctgacggaaagcattcccataaccgtttccagcaaaaactcttcgttatcaaaactttccacatgcttgacgcccgaaatgtctaaatgctttctccctttcatcgttacatcatgctgttccggaacagaagaagaacctttttgctcataatatgaattcatctattcagcccccatatcctcgatacttttagcattattactgcattgtatgaggcgggagccttgtttagaacaagcctattcgccgagtttttcttctttgacgattgtatacatgcccgcggcttcttcttttttcgttgtttctttcaattcatttaccttcacggtgacaagcttctgcccgaagcggaccttcagttcatcaccggcttttacgtctgagctggctttcgcctgattcccgttaacggtgattctcccttgatcggcgacctctttcgccaatgtgcgtcgcttaattaatctggatacttttaaaaatttatcaagtctcatatcagaatctcctctccatttcttttgcttcatcccacaatttgtccatttcctcaagtgacattgcggtcaattcaaggccctttgctgccgcttctttctcaatataagcaaagcgtctgcggaatttgtcatttgtcatggcgagcgcttcctcaggctcaattttatagtatcggccgatattgaccaatgcaaataaaacatcgccgaattcagcttttaagctgatttcatctgctgattcggcggaagcctctgcagaaaattccttcagctcttcatttactttatcccatatgtcctgaacgttatcccagtcaaagccggtttttgcggcttttttctgaagcttggcggctttcgcaagagaaggcagtgttttcggcacggcatccagcaatgaagaggatgttgtttgcttttccgcctttttgatttcttcccagttggcgacgacatcatgttcatcctgaaccttaacatccttaaacacatgcgggtgccgtctgaccatcttcgcactgatgtctctgatgacatcatcaattgagaaatacccctcgtcttctccgatctgggcgtgcagcataacctgaagcatgacgtccccgagttcttctatcatgtgatccgtgtcctcttcgtcaatggcctcaagcagttcgtagcattcctcaatcatatatttctttaatgactggtgtgtctgcttttgatcccacggacagccgttcggcccgcgaagctcgcgaataatacttcggaatgcagaaaattcctggtaaaggagttcttcttttttaatcggcggaacatacacgcttgttaagttatttatttctacattgcggtcaagttcaaacaaaggcaccttgatcatcttttctcccttgctcccggctgctgtaacgatgaccacttcatagtcgtcaggcaatttctccatgagcgtcagcttcacctcagaggccgtcatttggtcataaacctggcagatgatcaggtgatgccggagttcgagctcatccggcgtcattgtttgcgcatccgtaaattgaaacccttcaatcggatcaattcgcaacgcattaaaagtggcatccagaaagctttgccctccagcggtatgaacatctatctgttgttcttcccggcgttcaaataacagctgaacggttttctcagcgacaaacggatgcccgggtacagcgtagacgacatcctcttgcttcgctttttcaaacagaatgtccgcgatctcttcatagaccgcttcaaactgatcatgtttttcataaatatcatcaaaataccggatgtccgcttccgtctcttgctctaattccgaaatcaaagggtggtctttcgttcttatatataaatgcttcgcctgagtcagcagcttatgtacgcccactgtcaactgatccatgtctccggcgccgaggccgacgaccgtaatattacctgccatgtttttctctcctctttttcaatttgcttaaagcactgccgaaaggaagaccgctcagctcttcgtccgtgaaaatcttcattcttatcatacaataaataaacaatagccctccgatgattgacgcagacagactctcacatacagctccgcccctgctgacaggaacaaataactgccaaagcttcatgtatacgaccaaaaagaagaccatcagcagactgcaccagcacagacgggcaatcacgcctccgatattcgtcagccatcccttcgaccaaattctccggagattcaggcacgcaactgcggcaaatgccaagacggtcgccagtgccgctcctgtaataccccagccggggaccagccaaacattcagcacccatttcagcgcccctcccgccaaaacggatacggcggggaaaacggtatgtcccgctccttgcagaattgcggctgccgtaagcgcaatcgaggcaaaaaagatagataagctgaatatttgtaaggtcggcgtcccctcactgttttggaaaagcatgatattcaccggttctaaaatgcaaaaaagcccggctgatgcaccgatccctaccgcaaggcagagcttgacggcagatgacgctttctcttttatgataaacggcttgttctcatgcaccgcttttgaaattgaaggaaccaaggacgcggcgatactgacggcaaacacggttcccagctgaaggagcggctgtccgcggtcatatatgcctttcagctgtttcgcggcatggctctccgtcccgtctgaaagcagtgaatataagtttaaggcgtctacaagctgaatcaaaagcatgagtacactgctgatacagatggtgactgaataaagcagcagcttttttacaatgacggccgtttcgatatgtccgccgtctttctttgtttcttcccgcttataccagaaaacagccaatacacaaagggccgcaaagctcccggcaattgatcccgaggccgcccccgcacccgccgcgtataatgaacgcccgcttttcaaaagccagaaggataaaccgagaagcaccgccacccgaagaagctgttccgtaatctgggataaggctgacggcatcatatcatgcacgccttggaaatacccccggaaaaccgccgtaaacggaaacagtatgaaagcgaacgccgcgacccttatcagcatcacaaggcgggcatcacccataaaaccggccaacggcgccgcgccggcatacatgagcgcaaacagaacaagtccggccgccgtgacataaagggcggaaattttcattattttttgtttatgatcgctataatcgttcattaattttgagatgatcaccggaaaaccggatgttgacagcatgaccgcgatccctaaaaacggatacacctgctgataaatgtaaaatccgacgtcaccgacaatattctgaaaaggaaccctgtacacggcgcttaatatcttcgtcacgatgcccgcaacgacgagcacaaaagcacctttccatgccgattgccgcttggcgccaactgaatcgttcatccaaaagctccttccagccgctagaaaattacgtctataaaacgagcttattatatcacaatcctaacggccgaaccgatagagagcacatatgaatatgaaaaagaacagcacttgtataagagctgttctttccccgttttcttatttcaataatggtaataagacctactgctccatttgtctcgccaaaaaactggctgccgtttctaccgctttatgttctacttctccaagcgcctgttccttggaaaagatgaccacggcaccgataggatcgccatttgccacgatcggagcgattgtataggagctcatatcttcatcaatgtcattcacaagctgcgcggacttcacgtcgttttctaccactgagctgcgctgatccatcgttttttcgagcaaatcgctgatggctttattcagaaattcttttttcgaactgcccgaaacggcaatatacgcgtcacggtcgcaaatcaagacggaatggccgagactgtcatacaatgcatctgcatattctttcgcaaaatcgccaagctcactgataggagaatattttttcaatataacttctccgtcgcggtcaacgaatatttcaagcgggtctccttccctgattcgcagtgttctccgaatttctttaggaatgacgacccgtcctagatcatcaatacgacgtacgatacctgtagctttcatctctctggtgcctctctttcatgtgatgatatttaagggaaagtactaaagctctttactttatgtagcttccgccactcgcttgaaattagtatccgtcacatcaaatgtaatatacaccagagagtaacaatttttatgaagacgcgattgtttctttcttcacattctgaaggcctttcagcatgccgagcacggtctccagccactcttccgttttgcggcctttcgtctgtactgagattttcagctttttcccttccattcccagtccgatctgccggccgtatttattgccgagttcgaataatttctggccgtcaatctgtgcgctggcctcttcagaaatggtaaatctgatcgcgtctttatcctgcttgatgagttcgacgcgttcatattttccgtataccttcatctcagcaaccgtaaacagccattcaacttctttaggatagctgccgaacctgtcgatgatttcatcttggagctcatttttctcctcaattgtggcgattgatctgaagcgtttatacatgtcgattttttgcttgccgtcttgtatatagttttcaggaatatacgcgtcaagctcgatatcgatttctgtctcaaactgttcgcttttcggaatatcgcctttccgctcttcaatcgcttccttgagcatttgcgagtacaggtcaaaaccgactgagtcgataaagccgtgctgctgggcgccgagaaggttccccgctcccctgatcgtcaagtcacgcatggcgattttaaagcctgatcccagctcggtaaattctttaatcgcctgcagccgtttttccgccacctcagtaagcactttgtctctgcggtacgtaaaataagcgtaagcgacgcggttggaacggccgacccgtcctctcagctgatacagctgagacagccccattttgtctccgtcgaacacaatcaaggtattgacatttggtatatctacgcctgtctcaataatagtcgtgctgacaaggacgtctgattccccttccagaaaattgagcatgacgctttccaattcattttcggtcatttttccgtgggcatatgccacttttgcatcgggaacaagcatggaaatttcatcagccttccgctcgatgtcatccacgcggttgtacaggaaatatacctgtcctccgcgcgccagttctctttcgatagcttctcgtacaagcgcgccgttgtattccacgacatatgtctgaacagggaaacggttttccggcggcgtttcaataacggataaatcccgcacaccgagcatggacatatgaagcgtacgcggaatcggcgtcgctgtaagagtcagtacatcgacattggctttgatctgtttgattttttccttatgcgttacgccgaagcgctgctcttcatcaatgatgagcaagccgagatctttatagacgacgtctttagataagagcctgtgggttccgattacgatgtctaccgttccgtttttcagtcctttaatcgtttcattggattcttttctcgttctgaatcggctgagaagaccgatgttaatcggatagtcctgaaaacgctccgtaatggtttcataatgctgctgcgcgagtattgtcgtcggcacaagaagcgcgacctgctttccgtctgcgatcgctttaaaggccgctcggatggctacctccgtcttcccgtaacccacatcgccgcaaagcaaacggtccatcgggcgttctctttccatatcctttttaatctcctgaatggaacggagctggtcctctgtttcctggtaagggaaagcagattcgaactgccgctgcatttcatgatcgggcgagaacgcatagcctttgcttgcttcccgttccgcataaagcttaatcagatcatcggcaatatcctgaacggagttttcaacttttttcttcacccgtttccattcactgccgcccagtttataaagcttcggttcttttccttcagagccgacatacttctgcacctgatcgatttgttctacagggacatacagcttatcgctgccctgataatgaatgttgaggtaatctttatgaatgcctttgatttccagtgtttcgatccccaagtacttaccgatcccgtggttgacgtggacgacatagtcaccgacctgaagctcggaatagcttttgatccgttcggcatttgtcagcttctgctttctcggctttttcttgattcggtttttgaacagctcttcctccgtaatgacggccagcttcatcagcggcagttcaaaaccggattgcagctcgccttccatgacatagacctgtccttgcacaagcgctttggagctgtccgttttcgcggcttcaatttcgtaatcagccagcacggatgccaatctgtcggttctgtccttatttgcgcctaaaaagacgacggtgaagtttgatttcttaaagcgctccatttcacctgagaggacattcatctgcccgtgaaaactctgcatctgccggcttgtcacattcacgatattctgagggcttgtatgctggacatgacgcaaaaataatgaataataaatagccgggcgccgcttttcgctcataagctcctgaaagctgaaggataaatgaatgtcatgcagaattttcccttcctcgagcagacttgtcgtaaattcggcctcttctttttgcagctgatcctccatttcatgaatgcggctgacctcgtctaacaataacaacgtgtctgccggtgtataatctagcaaactagcaggtttttcgtaaaagtacgagagatacttcacaagttcctgatcagtctgtcccgttgataaccgttctttatcatgtgagatattgatatgaagcatttccttttgtttgtcctgcttcagctttttcagactgtcggcaagccctttatcgagcctttccattgcccgggctttttcttccgccctgatgatcaattccttcgccggtccgatcgccacatgtttgagcgtctcgattgatctctggtcatcagaattgaagcttctgatggaatcgacctccgtatcaaacagttcaattcgcaccggatgctccgacgtcagcggataaatgtcgataattccgccgcgaatactgaattcaccgggtgcagaaaccatatcggaacgctcataccccacctctacaaggcgcgcggacagctgatccggttctatatcgtctccgagtgaaatgacgagctggctgcttttccacagctccttcggcggaagcattcttctcactgccgcaacgggcgccacaacgaccggcgcttctccgtttgttaatctattaatgacatcaagccgctgagcgcgcagttcaggactcgctaccgcaatttctgaagaaatcaattcattcacggggtataaaaaaacagattgatccccgagaagcgccgtcagatcttccgtcactttttgggcctgatataaattatgggtgataaagaaaatcggccttttcgtttcctgtgcaagggcggaggtaaaaacagaacgcgcggaacctgacagacccgcaagcagctgttccttcagcccctcatgtaaaccgttgacaatggatttaaaatcatcgctttctttaataaaggtttgaatgttgtccatatgggccctcctctctattttctgcaagaacagaaaaacgctttggtctagaatctacaccaaagcttcttattgaataaatgtgttgtgttcatggtagtgcggattgcgttccagcgcctcttggcagtcttcacaaattgtaagaacatggacatctccattgtctttatatgaaatcatatcgtttctttcctcatttgttaagtgctgaaatccaagtgactgtgtcggcaccgttgaatattccaggctccctaccttaaagccgcagtggcggcagaaataatgcaaagccatacgttggacctcctgatgtgaaaaaatcatttttccctagtatggtctcccattatttatcttatacatttgcattaaattcgttcatgacttctaaaaatggtttcgttaaggaagcttcgcaggcttttacggtttttgagacggcatcattgatatgcggcgcttcttccttcgtaaaagctcccagtacatagtcaacgactttcattccgttaacggggcggccgattccgattctgacccggtcaaattcaggggttccgaggtgctgtataagcgatttaattccgttatgtccccctgcgctccccttcgtccgaagcctgatttttcccgtcggaagatcaaggtcatcgtatatgactttcagatcttcatgatcggcatcataataatccagcagcggccgcaaacattctcctgataaattcatatatgtaagcggtttaacaagtagaactttttttccggaaacaaaccccattccgtaaagtccgttgaatttcgttttattcagttcaatattccattctttagaaagctcgtcaatggccataaagccgacattatgcctcgtgttctcataggtttttcccgggttaccgagaccggcaatcacaagcatcgtaaatcctccctcaacatcgctgtaattcttctcattctagcacaaaagacgtaacctcgggcgggttacgtcttaaagcgcttattgattttctccttcgggctcttcctcaggagacggttctgcatcttcttcgaatgcttcctgcttaggaggaaggatggaagccacgacttcttccgggtcgtttgtaaatgtataattgccgtcagcagtcagatctgcgatggtcagcacatcattcatttcaagcccggaaatatcaacattaattgtctgagggatgtccttcggcttagccttgatcgaaagctcatgcagcggctgctggataacgcctccgtctttgactcctttcgcctctcccgtcagctgaatcggcacctcggcctcgagctcctcactcatattcacgacttgaaaatcggcgtgcgtcaattcgtttttgagcgggtctgtctgaagatcagtcaccataaccgattgctgatttccgttgacatcaattgtgataatcgtgttttttccttcgtcccgcaatgttttaagcaattcgacactgtctaaagagacaggcgtattcgttatttctttaccgtatataatccctggaacatgtcctgaatgacggattttccgaagcgtcgaacgtttaaaatctgttctttcatttgcttttaaagttgccatattcagcaccatcctaattatcgttttatcgtcctattagaacaatacccacaataactgggatttaaaccttaaagtttcggtttagctgaataaatagctgacagattgtttctcgtgaacgcggataatcgcttcagccagaagcggtccgacagaaagctgcttaaagcggtcgatttttttctcatcaggaagcttaatgctgttcgttacgacaagctccttgattttagagttattgatccgctcaacggcagggcctgacaatacagggtgcgtacagcatgcatacacttctgcagctccgttttcaaccagcgcgttagcggcaagtgtgattgtgccggccgtatcaataatatcatcgatcagaatcgctgtttttccttccacgttaccgacgatgttcatcacttctacctcattcggtctaggacggcgtttgtcgataatcgcgatcggcgctttcagacggtccgcaagtttgcgggcgcgcgtcacaccgccgtggtcaggagaaacaataacgatatctttcaagtctttaccttcaaagtaatggcctaaaatcggaacacccattaagtggtcaatcggaatatcaaagaaaccttgaatttgcggcgcgtgtaaatcaagcgcaatcacgcgtgtcgcacccgctgtttcaagcaggtttgcaaaaagttttgccgtaatcggttcacgtgatcttgcttttctgtcctggcgcgcataaccgtagtacggaatcacaatgttgattgttttcgcggaagcgcgctttagagcgtcaaccataatcagcaattccataatgtgctcattaaccggcgcacttgtagactgaatgatatagcaatcacagccgcgaatactttcttctatgttgatctggacctctccgtcactgaatcttgtaacagagcactttcctaattgaacccctacattatccgcgatttcttttgcaagttctggatttgaattcaaagaaaaaatctttaaattcttatctccgtattcgttagacatggtaaacctccgattttaggattattttttatgaatatttttcacataatcttctttatttacttgtcttgctctggcaatggcaagcgcttcgcccggcacatcttcagttacggttgaacccgcagcgacatacgcgccttctcccactgtgacaggagcgaccagattggagttgcagcctataaaagcgccgtcttcaatcttggttaaatattttttcttcccatcataattgaccgtgatggagccgcagcccagattcacatccgtgcccacttcggcatcaccgatatagcttaaatgagatgctttgcttcggtcgccgaattgtgttttcttgatttcaacaaagtttccgatcttcacttcattgccgattgcggaatcgggtctgatgtgagcaaaaggaccgatatttacatcattcccaactttgctgcggttgacaacggattgtttaatcacagtgcggctgccgattgaactgtcctctatctcagtgtgagggccgatgacacattcatcgccgatttcagcttgtccctttaacacagttccgggataaataactgtatcttgtccgatacgcgcgtcaggtgagatgtacgtattcatcggatcgattaaagtgactccgttctgcatatgccgtttgttaatacgctctttcatatacatttcagcctgagaaagagcgactctatcattcactccgagcgtctcttggaagttaccagtctggtaagcggcaacagtttcgccttcgtctttgaggatttcgatcacatccggcagataatactcgccttgggcattttcattcgaaacctgttcgatgacacgaaaaagagcctcgttatcaaaacagtacgttcccgtgttgatttctttcacaagacgttcttgctccgaagcatccttgtgctccacgattttttgaacggcgccgtcttcactgcggatgattcttccgtatccggcgggatcgtcggcaacggccgttaacaccgtggcttttgcacctttgtctgtatgttcattcagcatggcttccatcgtctccgccgtcagaagcggtgtatcgccgcaaataacgatcgtgacacccttttctccgtgaagaaatggttttgcctgcttgaccgcatgagccgtaccgagctgttctgcttggagagcgtaatcgcttttctgtccgagctgcttcttcacatcttcggcgccgtgtcctacgatggtgacaagcttcgctaaagataatttcagagcttcgtctgcgacgtgctctaccataggctttccgcataccggatgaaggaccttataaagcttcgatttcattctcgttccttttccggcagctaaaatcactgcaaaccgcttatccatttaatggcctccaatatcccttttatccatagaaaaatatatcctaaatagctgttgatttcaagaagacatcaaaaagtgcaagaattttctatgtaatcgctttattactgaaaaatcagatttaaaaaaggactgccggaaaaggccttgtgtcagcctttatcagcagtccttacattttgttatgtttaagaagccccggcttcttcatattctaatgcttcagaatcacccaaacgatgatactcatttaaaacagcatcctggatcttgccccgcgtgctggaattaataggatgagcaatatcgcggaattctccatcaggggtgcgtttactcggcatcgcaacgaaaagaccattgtttccatcaatcacacgaatatcatgtacgacaaattcgtgatccagcgtgatggatgcaatcgctctcatgcgaccatcggtattcacgcggcgtaatcttacgtcagtaacttccacagtagttcaccaccttttccctatataaaagcattagtctaacaattccacgattctttttaaattcctgcacgtttcaaaaagtttttttgaaaatataggatatacatacacaattaggtgataaaccatatttggggatcatatactgcataaaaaaagtgatcccggagaccggaaccacttttctgagatttaagattttaccagcgcaatgacttcaatttccacgagagcgtctttcggcagtctcgccacttccacacaagaccttgccggcttatgtacatcaaagtattgtccgtacacttcattcacttccgcaaactgctccatatcagcaataaataccgttgctttgacaaccgtctcgagagaagcgcccgcttctttcagcacagcttttaaattgctgaacacctgatgcgtttgttctgtgatatcaccgtttaccatttctccttcagcagtaagaggaatctggcctgagctgtaaaacatgttgtttacgatgattccctgtgaatatggcccgatcgctgccggcgcgtgtttcgtatggattgctttagtcatttttctgtctccccattctttaaatgctgttctttaaaaaatcgcagaaaattgccgttttgaatctcaatcgttttgtctttcatattgatggttgaaagcgtgagcagtgacatgtattcatcgacaagccgttcattcactccctcggcttcaaccaagacgcctatccccgcgacgtttgcattaaactcatcaagcaggctgatcatgccgttaatggtgccgccggctttcataaagtcgtcaataatcaaaacgttcgaacccgtagccaaacttcttttcgcaagcgacattgtttgaatgcggttagacgatcctgatacataattgatgctcaccgtggagccttcagtcactttattgtcctttcgtacgatgacaaccggaacgttcagataactggccgctgcgtaagcaagagggattccttttgtcgcaacggtcatcaccacatcaatctcccgctccgcaaaaacggaagcaaaaagcctgcctacatgagagaggacagatggttttcctaagatatccgttaaatatacataaccgcccggaaggatacgctcaggatttactaaagactgtcccagctcctgtataaacgcttctgcttcagcctgtttcactttcggaatgtatttgacgcctccggcagctcccggcactgtaagcagcgtcccaatgccttgctgttcaaaggtctgtttaataatcgttaaatcttcactgattgatgactttgctgattgataccgttctgagaaaaacgttaacggtattaattcatgcggatgggttaacaaataatttgttaagtccaccaatctgccgctgcgacgaaacttcatgaacttaccccaaaatccgaataatttaaaaataatataacttaacatacggatttaatcaagagcattctgttcgccgatcatccgcaccgcgtacacttgatcacagaaacctcttaacccgttataaatccgctgcacctttgattcgtattgaaccaaaccgaatacagtcggtccgcttccgctcattaacaccgcatcagcgccgaagcgtttcatttgatttttaatcatcgccacctcgggatggaggctgagcgtaaccgactccaatacgtttcctaattgtccgcataccttttggaagcttttttcttcaatcgcgtcaatcatcgcctgcacatcaggatgccgaacctgctgtaagttcagccggcggtacacttcggcagtcgataccccgatcgtcggtttggcgagcatgacccagcaatgaggcggagcactgatgtgcctgatcttctcaccgcgtccggttgccagggcagtgcctccgtatacacagaaggacacgtctgaaccgatttcagctccaagctctgcaagctcttcgacagaaagctttaaatcccaaagcctgttcagccctctgagcgtagctgccgcatcgctgcttccgccggcaagccctgccgctacagggatcacctttgtaatcataatcgaaacgccttttttaacttgaaaccgttctttaagcagtttggctgcctgataagccagattcctttgatcatccggaacaaagcgattatgcgacgccactctgataacgttttcgggcagttctgtcagttcaatccgatctgccaaatcaattgtcgtcatgatcatctccacttcgtgataaccatccgggcgtttactcgtcacatcgagggacagattgattttggccggcgctttttctaaaatacgcatagctttcacctacttctccatctaaacataagtatgaacattgtatcacatttggagacccggaggtacttatccgaaattgacgccggttttgacagccgatagaaaaaaccggggaacggattgtcccccgggccactgcattatcggttattttggttctgagccgccatctgctgttcggcaatctcgatcgcgcgctttaccatattcccggcgtcacgcgcccgaatgcctccccagccctcgtttttcaccgtatcgtaaaaaccaaggtccttcgccagctcatatttgaactcatctgacataactccacgacgtctgcccaaacgaaacaaccccttttatagaattgatcaccattcgtgcacgccacgataaaacatgtgacacctatagcttccgtttaatcggctgaaactttcgagggaataattagaagagctttagaaggcaaaacaaaaagcagtaaacaaaaggttcactgcccattaaaatgctactgagcttgccgcatcgtcattgaatgtcaattcaacagtctcagtcagaatatcagcataactgtatgaaactctttcaaacgaattctcgtcttgatctagttgtatcacaaaaacagaagggtacgtctcagctaaaatgcccgaacgctcaatcgtttttcggcggccgccgtttgcttttaacgtaagccgtttacctaaattcccatcaagcgatctttttatatcggacaacgtcttcgccattgcatccacctcactacatttattgtacaacaagagcccaattttgtcaaataaaatttaaattatatcaacgttaataagtcattgtcaacaaaattattttgacaaaattctattgatttctgcgttatttttcacaagttccggaaatttatgtatcaatatgtaaaataattaacccgcatagcgaaatatatgcgggttttatcactcatccatttgatttatacggcataccgacacgcagcacacccttcgtttcaattcctcccagccctttctctctcgtcagcgtatttctcaggacatcccatacattgatccgctccataaacggagtgaagctgattttcgcgacaatatataccgggtcaagcgcatgaatattgacgcgtgacggcgaacttgcgaaattcgcgcccgctctgattaaagactcaaaatgagattggcacgcccccgcgaatatgaccagctgatccaaatgagggactttacgcctcgctctctgaacggtttcgacaaagtgtttggaatgcctgtaggcgcttaaatcgttcacgcctcccttatgcttggaatatgcatcatggccggtgatgactaaaatatccggcctgtatttatcaagcagctcgtcaattgacgccggcatttttttctcatggcaatgaattccgtataccggcacaccgattttttcataaaagttcaggcactttttcaaataggcctcatcgccgtccagatgcaatacctttccgggcatatgaaagtagtgctcctgatgctgatattgatttgtcgcgtaatactcctgtttttcccgaagcagcttataatcctggcggagcagctcgagagattcattcatcctgctttcatctcttttctttctcatggcctgttcgtcttttctgacaggctccaaatcagaaaaatcagcatccgcaatcaatctgacttcgtcaccatgcaggatggcaattgaatttccgttgcttgtttgctctataccgataatgcgaaataaaacatccatttgataggatttcctggctaccatatctcctatttgaaattgcacgttacccactccacaaatagactaagcctcatcatgaaagaagtcttggcaaatgcacctctttccgctgcggcgcttgatgtttcaagcttttcttgcagttgaatgaataaggttctcctctagcctatgtagcggcagtccaagtggtgacgcaaaacaaaaagccctcttagaaaagggctttatgcaatccgttggacaagagcgcgaattcttctatggacagggattcaccgcgtcgctttccatcaatattcgtttcttgaagaacttcttcaatttgagcttttttctcttttccgcccggaagattgttcacaaggttgttcagcaaggttttccggcgctgtgcgaagcttgctttaatcagctggaagaaaaacggttcattatcgacgtcaaccgccgggccgtcacgaagcaagagacggatgacggcggaatcgacattaggctgaggcacaaacaccgttttcggtacggtcatgacggttttggcctccgtatagaactgaaccgcaatggaaagcgatccgtactccttagaggaaggatcagcggccatccgctcagcgacctctttttgcagcattacgacaattccttttaacggaagatgttcttccaaaagcttcatgatgatcggcgtcgtcacataatatgggagattcgccgtcaccataatttcatcacaatcctgaaactgctcttcaatgacggatttgacgtctgctttcagcacatcttgatgaatgatcgttacattgtcatacggagacagcgtatcattgagaatgggcagcagacgctgatcaatttcaaacgcgacgacctttttcgcccgtttggcaagctgctctgtcaacgcgccgattccgggcccgatttcaatgactccggtccgatccgtaatttccgcatggtccacaattctgtccaatatatttgtatcaattaagaaattctgtcccagactctttttaaaagagaaaccgtactttttcagaatttccttcgttctgataggtgtcgcgatatctttattgttcatcctgttcctcctgcctcatagcatcgagcgcatcaataaaatcacttcttttgatttgaaacatttgcagccgtttttgaagctgcttgccgtttgtatagccgatcttcagcaggtcgcccaatcgttcgcgccgtcttttggcagccggtccgccgatcagaccggcctgtatgacatcttcagctgaaatttcactcggctttgcctccatctcttcatgcacattttccagacatgctctgatgctttcaatggatgcgtgctcaacgccaatgccgcgcttgtttttcggtttggcaagatgtttgggcagaaatgcgtgtttacagccgggtactgcttcagaaatggttttccggatcttctcccccggaaaatccgggtccgtcagcacgatgacccctctcgtttcctgcgccagccgaatctgcctgatgacttcgtctccgattgcggaaccgtttgtctcgatcgtatccgcatcaacggcaagttttatgcgcgcagtgtcatcgcgtccctcgactactataatttctttaattttcattacttcctccaaaaaaactttttatatccaaaacgaaacctttgcttgcatgtcacgtctaatatactgaaaatacactttacctattataacgaaaaaaacagagggcgcaaaaccctctgaatgaatcggaattaatttaagatttttattttgacctgtttctttccccagcggtaagctgaagatttttcagggaaaaagacatcaatccgtcttcctttaatggctgagcctgtatcagcggctacggcatccccgtatccgtctacgtggactcttgtgccgagcgggatgacgcttgggtctaccgcaatgactttggcattcggattgcttgtcaggttaacgcctgtagccgtttggccggaacagccgctgcagcttgcggtataagccgtggaagacacggtaatcactttaccggaagatccggtttcgcccgaagatgccttcacaggtgcactgagctgctcaatcttgggactgtgccgctttgtgccgaccgcaatgatctgatctttgcttttttcagatgtttcttctttgacaagctttcttgatacttcttttccattttctttgacaacatgaaaatgctttttaagtttgccttcttttcctttttgaacgatcttttctttcccgctgtcgagagacgcatcttctttttctttcacttgatacgctattttttcctcaactacatcggtgactttttcgatacgagtgatttgtatgccggcctgattttttgtgagcttttcgtgtaatgccggttttactttatcttcgtctttcatgtccatcttatgctgcgttaaaaagtcagcgaccgtagtcgaagtcgtccatattttctttttctttcccgcatcatttacagtgacctgaaaagccgggtcgaccgtgactttcatgccgtttgtcactttcgtatctgctgctggatctattttatcgtgctgattcacaggtgtatgctgttcgttcagaaatgcgccgactgtttttgccgttgaccataaagtcttttcttctccgcctcttgtcacacggatctgctttgcagcatcatacacgacattcatgttgtctgccaatgctgtctgcttagacggggtaatccggtcttcatttctcgtctctatatgtaaatcttccagaagttccccaaccgtttttgcatgagtgcgtatttgctttttcttgccgttgatggaaacagaaactgattgttttgagagctcatgtgccccgtatgcagtcccggttccgcccagcagaataatagctgcaatcagaataaccttgcttttaccaagctttacggaaaacagttttttcattttttgtgtgatgaaaaacgcctccttctcctcggagagattatatagagtatctaaaatgctgtcaaccctcccatctcgaagatgaaaaaccttcagcgtatccctcattatgcaaaaacaaagcaaaaaaaggaagagagacatatcgacaacctatcttatgaggagaaggaagcttgtagaaccgttttacatatccactgaatcggacaagcttttacacgttatgacagcgcattctgtcagttcatgcggaaaagtctttttgcgttttcggttgtaattgaggcaatttcttcatatgtcagcccttttaattcagcgagctgttcagcaacatattttacgtagcttggctcatttcgtttgccgcggaaaggatgcggtgtcaggaaaggacagtccgtttcaatcagcaaacggtcattcggaatttcctttgctacttcttttggtttcttcgcatttttgaaggtaaccggtccgccgaatgaaatatagaaattcatatccatacactgccgtgcaacctccgtgctccccgtaaagcagtgcataatgccgccgacttcttccgctccctcttctttcaaaattgtgacaacatcttccgttgcatcacgattatgaatgataattggaaggttcacttctttggcgagagcgatttgtttccggaatacttctttctgaatgtcttttggtgatttatcccagtggtaatcaaggcccatctctccgatcgccacgactttttcgtgagaggacagttccttaatccatgataaatcttcctctgtcatgtcaattgcgtctaccggatgccagccgatcgcagcgtatataaagtcatattcctcaatcagctccatcgcacgcgtgatagtgggtttgtcgaatccgacaacgacaattcgttcaactttttcagcctttgcacgcgcaatgacttcctctaagtctgtgtcaaattgctcggcatttaagtgcgcatgtgtatcaaaaagcatcataaaaactcctttcttgttgaaaaacaaaaggtgttcgacggaatgttacacgtgaaacaccttttgcccctattatttaattcgagtgcctttcggtaatgactggtcgacagctacaactttgagaacgccgtccgattctcccgccagtatcattccttgagaaagctcgcctctcagttttaccggttttaaattcgttacacagatgatcttcattcccacaagctgatccggtgtgtaatgcttcgcgatacctgatacaacttggcgctgttcaaagcccagatcaatttgcaatttcagcagccgatctgcttttttcaccggttccgcggacaagacttctgcgacgcgaagttctgtatccataaattgatcaaacgtaatttcaggaagacgctctgcttcttgcggctcttccgccttttcttctttagcaggagcagttccttgcattttttgcttgatgtaagctacttcttcttcagcttcaagacgagggaaaagcggttccccttttttcactttcacattcttcaattggccgaatgtctgaatgctgtcccaagctttaagagactgatcctcaactccgagctgggaaaacattttttcaggcgtctgcgtcaagaaaggctgtagcaatacggccgaaatacgcaatgattcagctaaatgatacatgacagaacgtaattctttttctttttcctgatctttagcaagcacccacggagcagtttcatcaatatatttgttcgtacggctgattaattgccatagcgttgataaagctactgaaaactccatgttttccattgccttttcataagctttaaccgtttcaccggctacggaagaaagctctgaatcaaaatcggtcacatttccttcatatgaaccaatctcgccgtcaaaatatttttggatcattgcgactgtacgattcagaaggtttcctaagtcgttcgccaagtcataattaatccgttctacgaaaccttccggcgtaaagacaccgtctgaaccgaacggtacttcgcgaagcaggtaatagcgaagttcatccaagccgtagcgttcaattaacgttaccggatcaacgacatttccttttgatttcgacatttttccgtctttcatcaataaccagccatgcgcgaatacttgcttaggcagcgggagatcaagcgccatcagcataatcggccagtaaatggtatgaaaacggacaatttctttaccgacaaggtggacgtcagccggccagtactttttgtaaagctcatcattttccgtatcgtaaccgagcgctgtaatatagttgaacagtgcgtcaatccatacatacacgacatgcttcggatttcccggcacttttacgccccagtcgaacgtcgttctggaaacggccaaatcttcaagccccggtttaatgaagttgttaatcatttcatttttgcgtgattcaggctggatgaaagaaggattttcctcataaaacttcagcaggcggtctgcatatttgctcatgcggaagaagtatgactcctctttgattaattcgaccgggtggccgctgtcagggctttttccgccgacaacctcacccttctcatttcgttccacatccaccagctgtgtttccgtatagaatgtttcatcagggatgctgtaccagccctcatactcatccaggtaaatgtcaccattatcaagaagtttttgaaacactttctcgataatttctttgtgccggctttccgtcgtccggatgaaatcatcgtgagaaatgtcgagctgcttccatagcttttggatttcagcaactgcgcgatccacataagcttgaggcgtgatattctcttcctccgctttctgctggattttctgtccgtgctcatccgttccggttaagtagcgtacgtcaaatccttttaatcttttgtaacgcgccatcgcatcgcctgccacggtagtataagcatggccgatatgtaattttccgctcggataatatatcggggtcgtaatataaaaagtattattgtcttgcggcatgttgcaacctcccattcagaatgtcgaaaagctcacgcccaaaggacgagagcggttttatttgatatacaatattgatatttgtcctctatctatgataccatcttagcctttaagatcaaggatatatacgtactgcgcgtaaaagagtaaataaaattaaaaatttttattgaaattaaaaaaagtcttaacatgtcgaaatttgtcgtatataatctactaatataaaacatcttggttcgaaagtcttgatttaaaaggattttcagtaggataataggttcgaaaaagcagtcaaaaagcctgttatttcaggatttccaaggctttacttactataagaactaattcttacaaacaatagcaaacaaaaagattgacgattattggaaaccttgttatgctaggaatgtaaggaattttgtcgaataatgacgaagaaaaatataaactacaaataattatctctcgggaggagactgttaatgaaatctactggtatcgtacgtaaagttgatgaacttggacgcgtcgttatccctatcgaacttcgccgtacactgggcatcgcagaaaaagacgctcttgaaatttatgttgatgatgaaaaaatcatccttaaaaaatataaaccaaacatgacttgccaagtaactggtgaagtttctgatgataaccttaaacttgccggcggcaaattggtactcagcaaagaaggcgctgagcaaatcatctctgaaattcaaaaccagcttcaaaaccaaaaataagctatttcatacaaaaaccgttcttgttatgacacaagaacggttttttttatgattgaatgtgataagcgtcataaatctcgcgtttcggtacgtcccgatctaccgctgtttgttttatggcctgtttggaagaagatccttcatttatgtaatgctccacatgttctttctcagaaagctccgcccaccaaggcttttcctcttcatccggttcagcgccttgattgccttcgacaacgagacaaaactcaccgcggatttgatcttcatttgcccattcaagcacctcggcgatggttcctctgatgaattcctcatactttttcgttaattccctcgtgacggcgatggttcgattacccaaaacgtcatgcattgctgttaatgtttcttttaatctgtgcggcgcttcgtaaaatatcatcgtttcctgccgttttttcaggatttcgagttctttcttcttttcttttttttgtctgtttaagaatccgtagaagaaaaacggctgcggggtgatccctgatgcagtcagcgcggttaatgccgcatttgcacccggaagcggaacgacatatccgccgatttgggtgaaatctctcacaatctcagcccccgggtcggaaattgtcggcataccggcatcactgaccaatgccacattctttccgcttttcagccattcaatgattttatggccgctgctttctttattatgttcatgatagctgatgagagatgtttctatgtcataaacatggcacagctttttcgtctgtctcgtatcttcggcagctatgacatcggccgatttcagcgtctctactgcacgaaaggtcatgtcctccaaattgccgatcggtgtaggaacaaggtacagagttcccatttcagattttccgttaaaactcatctgacgtcttaacatatacagcctccttgctgcgtcgtttttcttctatatattgctcttttttctttcgggtcagctgcttaaaacggtattccgcctgcatcgcttcccgttttgtttcaaatgattccgcatggcataacgaaaccggccttctcgcccttgtatatttcgcgccctttccctcattgtgggttttcagccgtttttgcagatcatttgtataaccggcatacagactgttgtcattgcacagcagcacataaaagaaatgactatttgtctccatataaaatcgtgcggatctctttcgtatattcattttgttcattatatacaaagagcgggggaagaattttgagatcagggcggccgcctttaattccttcaaccaaaatggtattcgcttctttaccttgtttcggataaataaactgaacccgtttcggttctattcggtatgctttcattagttcaaagatttccagaagcctccccggccgatgaacgagagccgcttttcctccttgcttcagcagtttgctgctgacggaaatcacatcttcaagcgtgcaaaggatttcgtgccttgcgattctgagatgctcgttcaggttctgctccgcctctttcggtgttttaaaataaggcggattgcaggtgacaacatcatatttattatgtccgagtctttccggcatatttttcagatcatcatgaatgagactgatctgaccgcccagcccgttgtattccacgcttcgaagcgccatatcatacaagcgttcctgaatttcaactccggtgatatcggcttttgaccttgtgctgagcaaaagcggcacaatgccgttccccgtgcataaatcaacaatgttccccttttgaatcggaacgtatgcaaacttagacagcagcacggcatctaatgaaaaagcgaaaaccgtcggactctgtactattttcatatcctctgctaataagtaatccaatctttcatcatcacgtaatgaaaccataatcttattcctttcggcactctttgaaaaaggcttccgacatcagcggaagccttttccttattttttatttaagaaggacagacaaaaaaggcaatctcccttgcggacgctcccataatggacgttgcaaatatgaaagccttcttgatacagccgggccagattgtcgtacccttctcctatatcactctgctctgccttctgtgtttttgtttctttctgatcggctttgaacttctcaatttgctccgtcgtgtcatcaagccgcttacgcaaatgcttattttcaagctgaagatggtgattctcttcaatcatttcgccgatatgctgctttaagtcacccagctgacggtacagcgaaccgatttgttcctccaggtttatgacagtatcaaataactcttttttatccaaggttccacacctcgttaatctgtggtttgtgcggatacgacgccctcttccaagagctcttcccaagtatattctatcactttttcacgattcttcagttccacctgaagcacccgttccagaatattaagaccgacaacctttgcggggccgtttgccgtcgtaatcatttcgcctaaatccggcagctgttcttttgccgtctcatactcatcattttcatacttcaaacagcacatcaaacggccgcacagaccggaaatcttcgttgggttcaacgataaattttgatccttcgccattttgatggacaccggttcaaaatcaccgaggaacgtggagcagcaaagcattctcccgcatggtccgataccgccgagcattttcgcctcgtcccttaccccgatttgacgcaattcgattctcgttttaaagatagaagccaagtctttgaccaattccctgaaatcaacccgtccgtctgccgtaaagtaaaaaatgactttattgcggtcaaacgtaaattcaacatcaaccagcttcatatctaagccgtggtcagccacttttttctgacagacttcaaaagcggacagggcctcctgtttgttttcttctacaatgagaagatcgcgttcatcagcaacgcgaataacctttcgaagcggaagcacaacatcatgctcgtccacttgtttatttgcgatgacaacctgcccgtattctacacctcttacggtttcaacaatgacgcagctgtcttgttctatatcaaatccattcggatcaaaataataaattttccccgcttttttaaagcggacgcctattacgttgtacaagcttatccctcctgcaacgttaacaccaagtgctccattaatccctgcacattcacattggaatgaagccgtttttttgcttctaaaacagcgagaatttggttcgtaacgctttgttgtgtaaattgcagcgcatgctgttttattgattggaataagtcttgataaatcagtttatcttcatttccaatttggatggataatacatcacggtatatcaataagagcatatcaagacccatttcttgatgggttttttctttgaaaaagggcacccactgatcctgaatgaagaaaaaggcatgtcctttccgctgatgtaagacttcatacaattttatcactttcgctctggactctgcaaactcatcatttcgacttaattcgactgcttccgcaatattatttgtcatatttgctaagagccgggccatgtgagggctcacttcctgttcaatcagtctttcttctatggctttcggctgaagcggctggaacgggagaacctgacatctcgaaacgatggtatccagtattcggtggagctgctcagtaatcagaattgcgatggtgtcttgactcggctcctctaaaaacttcagcagactgtttgccgcatttgtggtcatttgatccgcatgggatataatgtacagctttttatgcgattccagccccgttttggaaaactcttcctgaagcgattggatctgagcctttttaatggataatccgtcgggctgaaccacatgcaggtcgggatggtttccggattcgatacgcttacagttccggcactctccgcaaggctcagtcccgtcttcaaggcaaaaaaagctttttgcgagaagcagtgcggcatccaatttgcccgtaccttttttgccttcaaacagatatgcgtgagaaagccttttcttttcaatgctgttatgcaaaagccgcatcactctgggctgctgcccggtcatttccttccatgatattgccattgtatcactctctatgtgtaaaggttaatcaataaaccttttatttctccgattcgatccagcaaatcaattgccggtttttcctgatctaacatttcttccgtcagctgaagcagtttttcatctatttctttcacaagccccagggtccggctgctgccgtacaagtcaaagcttttctccgtctcatgcgataatccgctgtctacggcctcttttacaaaacgttttaccaatcctttgaacttcgctaagtctttgaagtttctcgacttcgtcagccttttcccgaacgtttctatatccgttaagaacctgctcagctgatcaaatttcagcttgctgctttggctgtccattgaacttttaaacgttccggaaagctctgccgctttataagcaggctgctgctttttctcaataaatgtacgtaagtcagaatttattttcacgtcgtcaaatccttaaaattgatgaaattcatcgaccgggaggacaaagaccgtcgctccgccgacttccacttcgacgggatatggaacgtaggaatccgcattcccgcccatcggggataccggggcaatcatctgatcacgtttacagccattctctttaatgaggctgagcgctttatcgacacggatatcttccaccccgatcataaacgtcgtattgcctgatttaaggaatccgcctgttgtcgcaagcttcgtcaccctgaagttgtggtcggttaatactttcaaaagcctgttgctgtcctgatcctgcaccactgccactattaatttcattctctaggccccctttaggttggaaagaacattgtcgttacattcattatagcaacttatgagaaacaggtcacaactgaatttttttcaatgcttcatttatcacttgaagtgcgtcctgaatgacgagttccttctttttcgatgcgtcgattgtatggaatctttccggaaaacgctgcataaccttttggtatccttcccgtactttcgtgtgaaagtgcagagcctcaagatcgagacgattcttttctcttgaatcattcgacgtaatccgtttcaacccttcttcaggctcaatagaaaaatagatggtgacatcaggcatcgtatcgccgattgcaaactggttaatagaaagaacttcatcaatgccgagccctctcgcatagccttgataagccagcgaactgtcgatgaaacgatcacacagcacaatgcgcccttctttcaatgcaggctgcaccttttcggttaaatgctgtcttctcgccgcggcgtaaagcagcgcctccgtttttgcatccatcagtgtattgtttttatttaagatcacttctctgatctgttccgcaatgtcgatgccgcccggttctcttgtcgctgtcaccgggagcccctctgccgacagaatctctttcagttcctgaagcacagtcgttttccctgcaccttcaggaccttcaaatgttataaataaaccgctcatgatttctcctcttctatatagacaagtaattgttccccgtttaacaagccttgaatatgcgcgtccatgccgattaaacgggaaagcttctgtacgatctcttctgttatccgttcgccgtccatgatcagcggaattcccggcggataaggaataatgttccccgcatgcaagcgcccggccgccttatttatatctgcaggctcttttgtaaacttccgcatctcattttgcggatattcaagtgtcgaaatggacggaaatgtccaattcacggcatccggcaatttatcgggcggtgtattctccagtttctgctgtatgtttcttacggctgcctgttctatcatccgccggccgcctatcgacagtacgagcaatacttggtactcgtcagccagctcggcaacaatgccctcactctccaaaatgcgttgtaatgaatagccggaatgtccgagctttgaccgaagtattaattttaacgggtccgcccgcagcccatatccggaaggctcgattatttcaatagaagaaattgatgcgaaccttcgtttgattttctcaatgtgctccatatggacgggaagtgtccctttttcagcaatatcctgcacataagcacgcgccgtatctaaagatgccataatcgggtatgacgggctgctgctttgcaaactgcttacataataagttaatcgatctctgtcaattcgggtgctgtttaaatgaaagtaagatcccatcgtcatagccggaagcgttttgtgagccgattgaacaacggcgtccgcccccatagccaatgatgaaggcgggaaaggctgccctaacacaaagtgagctccatgagcctcatccaccagcacaggaacaccgtatgaatgggcttttttaactgccgcagtcaaatcggcggcgtgtccgtaataagtcggattggtcaaaacaagtcctttcgcgttcggatatgacgccagcgctttttcgatgactgaaagagatacatgtgccggcacatgcatattttcatcgatttccggcgccaaataaaccggcttggctccggccaatgccaccgcatggaaaacagacttgtgacaattacgctggatcagaatgggttcacccggttcacaaacagctaaaatcatcgccagattgccggcggtcgttccgttgacgagaaagaagctttcctgagagccgtacaatctgctcaccaaatcctgcgcttccttaatgacccctgtcgggtgatgcaagtcatcaagacccgtgatctcagtcatatcaatagataaaagagattgatatacagatttcgcttcatcaaaaaagacatctccattgtgatgtcccggaacatgaaaagaatacgtatttcggtgcgcatgcttcatcagcgctgtatataaaggtgtgtccatttttaaacaaatcctttgcctgtctttcttattatatcgtgcctgcgagccaacttaaagctaagactttttgccatctagccgttatcccggccggaactcatatcaagcagcttcttttttaaatcgccttccatgataacaagctcctcctcggcacgcctgcgtttcatcctgccttcttcttgaatagacatgatttcttcaagtgtgctgactaagctttcctgcacttttttgagggtgtctgcctcaacaagtccgcgctcattggctttggccgtctcgactgtgcttgttttcagaagttcggcgtttttcagcagcaattgatttgtcgtatccgccgccttcttctgcacatctgccgcactccgctgcctcataagcgtcagcgcgatggcgacttgattcttccataaaggaatagccgtaacaatggaggactgaattttctctgccagtgcctgattcgtgttttgaatcagacggatttgcggcgcactctgaagcgtaatctgcctgctcagcagcagatcatgcaccctcttatccagacggtcggcaaactggcgaagatcattcacttcctgtgcggccatttgattgtgttttcgtaattcggcttttcttgccacttcgggaataagctttgttttcagctcatctaattttaattcacccgctgctatatacatagttaaatcagaaaagtattgtttattttggacgtacagctgatctaaccatttattgtcactcaacagcacatttttagaatgttccagccttctgctgatacggtcaatctgcacacttgtcttttgatatttcgaaagcacttcctgcacagatccggatacccttttaaacagccgggcgaaaaaccctttgttctttacctgcagatcatcggggtttacctggtcaagcttcagcatcagatcagccaatatctgtcccatctctcctgcatcttttctttgcacgtgctctatcatcgtgtgggaaaattccagaagattcgcctgcgcctgtgaaccaaacagaacaatgctttgcatgtttccagggtccagtttttcagcgagctgaagtgccgcttctcttttttcttccggcagcgtatctgcaagctttagatgagtctggtcattttgggcgcccatactgtcgtcggaacggtctttggccatttccttcttcctttcttattttctcagtgaatgctttgccatatctaattcaaagtgcaggtcgtcgatgtcctccttcatcagttcatgaagatcttcttccagccttctggaaagctccgccagagtcatcctcgtctcactcaaggacattgataaatctttattttttcgcggctgtgatgagagcaaagcatacttttccgtcagttccacaacagaatcaagcgtttgataatagaaacgctctgcctgataaaaacgcttcggctcctgctttgtgagcagatatattcgtcgggttatccgcagtatctctgcattctgcttcagcatttgtatacttttagagcggaaaagcgccctgcgtaatcggatgattttaccctttgcttcctcgagattttccttgatataagcatattcttttcttgtcagccggtgtttttttaaaaagagacgcttcgcattccacaagccggacgcactgactgcggctccgccggccgccccgtataaaagcgaatacagaaaaggctggtgccctatcgtaaagaaggttatccccgctaatacaaaaactgtgctgccgcaaaatgtccatttcatatattgaataaacggtttcatacttgatcgactcctatttattcacttttatcagtattatctattacattccatgtctaaacaagttcctcttcttatcgtatcagttcttttataaaaagtgaaaaaactcctctgatttcaggcaaaaaaaagacccttttcagggttaagaatataacgtcggtgtatgaaggcttttcaatttacgaacgaaaaattcataattcggatcagaggtcggagtggaaactactttcttctcacactctaaacatataaatttcgtataaatatggattcccctgcttttcttggtttcacacacaatacatgtttcttcatggccggacgtttcattcattttgcccacctccgtatgaatagccttcccttaaactgttgattgtatacacaatttggatctttttgaagtttgcaattagtatatgggcgttcccgtatttcggtgtttgtttcgtttttattcaaaaacaaaaaaggcagctcatgatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacagtaagcatacattcaaattggttaagtcctcgatcgattagtatctgtcagctccatgtgtcgccacacttccacctcagacctatcaacctgatcatctttcagggatcttacttccttgcggaatgggaaatctcatcttgaggggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttgggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtcccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtagggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaaattccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcagacaaccatccggtattagccccggtttcccggagttatcccagccttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtgtttgactgactacgcacatcgctgtgcgatttatttaaaactttgaattaacaggtacgttttgtcttgtttagttttcaaagaactttgtccatcgctcttgaagcgacttaattattataacatctcagtgtcattgtcgtcaataactttttaaaatttctttttcaagaattcgtttcgtcatcagcgacgtatattagaataccacccttgatccaacatgtcaacaataatcgacaaattaaatgatgaagcgtttaatgactatcaaagccgcgataccgggaatcccaagaattccgctgatgcccgttgtaatcaggttaacagggatatgaatacccagactgccccgaacaagttcacacccaccaacagaatcgcgccggcaataaacttaatggcagtcacaccaatccaccttaacggttttgaagatactccccataaaaaaagcaaagcaaccagaccgacaatcaaaccgataatgaaaaaaggctccatgaatcttccccctcgcttgtttagtacaagcttatgagaagattccggagaatagacctcttacttccatctgctcattttcaaattccgctgcttcgcttctttcaaataaaaaaagtacttagattcagcgactttcagctcaaacaacacctcagcggagggctctagacttttctcgaccagactcttctgtctgttccattcttctttttgtttaaagagctgttctatcagcttctcgtcaaactcttttcttaatgtatttctgcgaagaaaacccatgccttgccttttcctcccttacaattcacgtcttccttcaagagcttttgaaagagtgacctcatcagcatattccaaatcaccgccgacgggcagaccgtgggcaatacgggagagcttgatgcctgagggctttaacagccttgatatatacatcgctgttgcttccccttcaatattagggttggttgcgagaataacttctgtcacttgatcatcctgaagacgtttcagcagctccggaatcttaatatcctccggaccgatgccgtccattggtgaaatcgcgccgtgaagaacatgatactggccgttatattccttcattttctccatcgcgatcacatccttagggtcctgcacgacacaaataacagacttatctcttcttgtgtcctcacatatataacaagggtcctgatctgtaatatgtccgcaaatcgagcaatatgtcagattccgcttcgcattgacaagcgccttagcaaaatccaatactgtgtcttctttcatacctagaacaaaaaaagccagacgaaccgctgttttcggtccgatccctggcaatttcataaagctgtcaatcagctttgatattggttcaggatactgcatgtttatttatccccctagaataaacccggtatgttcattccttttgtaaattgtcccattgtctcattcgtcatgtcatccacttttttgagggcgtcgtttgtcgcagcaagaaccaggtcctgaagcatttcgatatcttccggatcaacaacttcttctttaatggcaacgtctacaacttctttttggccgttgacttttacagtcaccataccgccgcccgcagtgccttcaagcactttttcagcaagttcctcctgagccttcgccatatccttttgcattttttgcatttgtttcatcattttttgcatgtttcccattccgccacgcatattcaatcactctctttcatcttattagtcttttatttcgattaaatccgctccgacaagttttttcgcctctgcaatcagcggatcttcttcagccggttcgtttgatccttcactttcctgctggtgatcatttaaaaattcttctcttattttaccccattgtgcttccggaacgccaatcaaatccattcttttcccgagcattgattcgagaatctgttcaagattcgtacggactccgttattgtcttctgcaaccattttacaatggatttcgtatttaaatttaagcacaaatgccttttgagcagcggccaccggttcactgtcattcaaaagagccgcatgagacaccttattctgctgtttcaggtgtgccagcagcttgccccagctgcttttaagctgttcaagatcaggtcttgtggcttccttcaatatctcatgaattcttccgaccggggctttataatggctttttccgcctttttgaggacgcggagcttctttcggagcgctttccatctgaaccttcacaccggaggttttcagcctttctacttcctgctcaagctgctggatcttattcatcagcatgccgacctcagggatgtctccggcggattgctgtgccgtttggcatattttcacgacagccacttcaaaaaagattcttgggtggttcgtccacttcatttcctgatggcttttattcaggatatcaatcatctcatataaagcggggccggtatgtcaccgctcagattccgaaacgtttcatcgaccttcaccttctccaggactccttctaaaccgggagcggcctggtacaagagcatatccctgaaatagaaaatcatatcttcaatcagtttggccgcatctttcccctgctggagcaattcattcagtgtttccaatgcctcggaaacctgtttgcggtgaagagcagatgccagttttccaatatagtgctgagaaacggctccggtaatgagcaaagcgtcatccaccgacagctcctcgccgctgaatgatacagcttgatcgagcaggctcagcgcgtccctcattcctccgtccgcagcactcgctatgatatcaagggctccttcttccaccttcagctgctctgcatcgacgattgtcttcattcgtccgacaattgctttggatgtaatccgtttgaagtcaaaacgctgacatctggagataatggttaaaggaatcttatgaggctcagtcgtagctaatatgaaaatgcaatgtgccggcggttcttccagcgttttcagaagcgcattgaatgcgccgatagagagcatatgcacctcatctataatatataccttgtaagtaacggccgacggggcaaattttactttgtcacggatgtcgcggatttcgtctacgccgttattcgacgccgcatctatttcaatcacatctgatatagagccatttgtgatccccttgcatgccgcgcactcattgcacggttcttctacaggggcgtgctcacagttgactgctttcgcaaatattttagctgcactggtttttcccgttccccgcggtccagaaaacagatatgcatgagaaaatttcttttgcaaaagggcattttgcagcgttttcgtaatgtgttcctgtccgaccacatcttcaaactgctgaggcctaaatactcgatataaagcttggtaacccacaggatgcgccctcctctgttattcatcatgtttattatacatgaacgtgcttttaacgccaaaacccgtttttcatatacgaaaaaactcacctgccataacaggtgagtctgaaatttgatgattgatttaccgtgcaccttctgtcgattcgctaccctaagcgttacttaagcagttagctcagcccaggcaaccctgcggcacatgagaggtttcacttaatgctgcttccttccggacctgacatggttcatgaattcccattgcgcaggacccagacgtcaacgccacttacttaaggcagaccttacagtaaacgaacctcgagaagggattcggccccgctagagcggattgcgggtacagggcaccgctacctccccgcttagcacggcaaaataaatatcaaattttgatatgcgcaccattcatgatgcacacataagtatatctgcttcaggcagaaaatgcaaccgtactactcagacaactttttcctcatgtctttcttttgccggcgcagctttctgaaaaaagcgctgagcatttctccgcactcttctccgagcacgccgctcaccacttccgcttggtggttgaaccgctcttcctgcaagaggttcatcagcgttcctgtacagcccccttgggatcaaatgcgccgaatacgaccttatcgactctcgaaagcacgacggctcccgcgcacatcggacacggctccaaagtgacatagagaacggcatcctcaagtctccatgtccccagcttacggcacgcttcgtctatcgccagcatttcggcgtgggcaagcgacctctgttcagtctcccgcagattatgcgcccgcgccacgatctcatcgtgcagaacaagaactgctccgatcggcacttcacctttctcttcggctttcttcgcttcttttatggcttctctcatataatattcatcattcatcggttcgagctctcttcttaagttttttcatgtctcataaaggttaaaataggaataccccagcagaaaggagttgccggtattgtctgaacctaacaacacagcccttctgattgtcgatatgatcaacaattttcaatttgatatgggcgaacgtcttgctgaaaaaaccaaacaaattgtcccccgtattttatcattaaagaagcatgcaaaacaaagcaactggccgattatttatattaatgatcattacgggctctggaaggctgatattgatgccatcagggaggaatgcagcaacgacagaagcgcctccattataaaagatatttcgcctcagccggatgattattttctcattaaaccgaagcattccgctttttacgaaacggcgcttcacacccttctgaccgaattacaagtgaaccgattaatcatcacggggattgccgggaacatttgtgtgctgttcacggccaacgacgcttatatgagagaatacagcattgccattccgaaagactgcaccgcttccaataacgacgaagacaatgatttcgctttgaccatgatggagaatgttctcttcgcagaaataaccacggaaaaacaaattaccggcgaaaaataaacatgatcagcctccttttttcatatatttgatagcggatatgaaaggaggcgtttttcattcagatctatatagtgaaacggggcgacacgctttccgctattgcggcgcgctaccggacagccgcaaatgtcattgcggaagcaaataaactgcctaatcccaatacattggttgtcggacaaacccttgtcatcccgattgagggtcaatattacgaagtaaaacaaggtgatactctcgcgtcaatcgccggccgttttcatatatcggccgcggagcttgcgagggtgaacggaattcagcccggcaccacattgagagtcggaacccgcctttacattccgcagcaggcgaataagcccgatatcgaatcaaacgcatatatagaaccgcggggaacgagcgtaagcgctaatcttcagcaggcggcaagggaggcctctccttatttaacatacctcggcgcattcagttttcaagtgcagcggaacgggactttaaaggaaccgcctctgaccaatttaaaaagcatcagtgacaggcacaacaccacactgatgatgatcatcaccaaccttgaaaatgacgcattcagcgatgaactcgggcggctcatcttgaacgacaatacagtgaaaacaaaactctttcaggaaatcgtctccacggctaaaaagtacggctttcgcgatattcactttgatttcgaatatttacgtccacaggacagggaagcctacaatcgttttttacgtgaagcgagaacgatttttcatcgggaaggctggaagatttcaacggcgcttgctccgaaaacgagcgcgactcaggccggcaaatggtacgaagctcatgactatagggcacatggagaaatcgtcgatttcgtcgtgattatgacatatgagtgggggtacagcggaggcccggctgaggccgtatcacctatcggccctgtaagaaatgtcattgagtacgcgctgacggaaatgccttcttcaaaaatcgtcatgggccagaatatgtacggctatgattggacactgcctttcaaacagggaacgacagcgaaagccgtcagtcctcagcaggcaatcgctctggcagcacgctataaagtcgacattcaatatgacgaaaccgcccaggctcccttcttccgatacacggatgcaaatcagagacggcatgaagtatggtttgaagacgcacgatccattcaagcgaaattcaatttaattaaagaacttcatttaagaggaatcagctattggaaactcggcctttctttcccgcaaaactggcttttgctcggcgatcaatttcatattgtaaaagagacgtttcgttaattgggagcgtcttttttcatgggcttttctgtgagtgtgatacaatataaaggccggcagctgacggatgtttgcagaattaaggaggattttcaatgaacagagccccttttatcgcggtagaaggtcctatcggggcaggaaaaacgacactcgctacgatgctttctgaagagctcggttttcctatgattaatgagattgtggaagacaacccttatctcgataagttttatgacaatatcgaggagtggagtttccagcttgaaatgttttttctatgtcacaggtataaacagcttgaagacaccgatcgagattatttaaaacaaggacagcccgttttgtccgattatcatatttataaaaatgttattttcgcagagcgtacattgcacggccaaaagcttgagaagtataagcagatctatcatctgctcactcacgacctgccgaagccgaatatcattgtatacataaaggcaagcctgccgacattgcttcaacgcattgaaaaacgcgggcgcccgtttgagaaaaatatcgaacatcaatatctggaacatctcattgcagattacgacacagccatcagacagcttcaggaagaagatccggatatatctgtactgaccattgacggtgatactgaagactttgttttgaataagacagactatgaaagaattgcccgtcaggtaaaggagcttattaaatgaaagacattcatattccaaacaacgccattataacagtagcgggaacggtaggagtcggaaaatcgactttgaccaaagctttagcaaaacggctcgggtttcatacctcacttgaggaagtggatgaaaacccttatttagagaagttttatcacgattttgaacgctggagcttccatttgcaaatttattttctggctgagcggttcaaagagcaaaaaaacatgtttgaatcaggcggcggattcgtgcaggaccgttcgatttatgaagatacaggcatattcgcaaaaatgcatgccgataaaggaaccatgtcgctgacagattacacaacatacacaagcctatttgaggcgatggtcatgacgccgtatttcccgcatcctgatgttttgatctacttagaaggcgaccttgaatacattataagccggattgaaaagcggggccgcgagatggagctgcagacaaaccgctcttattgggaagagatgtatacacggtacgaagactggatcagcggttttaacgcctgccctgtactgaaagtacgcattgaagattatgaccttgaagctgatgaacagtcactggaacctttgatcgaaaaaatcagtcacgtgatcagcgaaaacagaaacaaataaaaatagcaaagcgattttccccgaacagagaaaatcgctttttttgcatataaaaaatccgctgcatcagatgcagcggacaaaacaatctccaatatatgctcgagtttcattaggtttaaaatcaatatggcggaggaagagggattcgaacccccgcgggctttgacacccctgtcggttttcaagaccgatcccttcagccagacttgggtattcctccgtatcgacatttaataatataccacatgacccaaatttcagtcaagcgctttttcatattttttatttcatttcttaaacagcttttccgtcagctttactatcatacaaaagtcttgcgtccaattcaacctcagtatgccatacgggcaggaaaacaaagtaaaaatcaagaatagattcaaacagataacctgctcataaaggtggagaacataatgaaaatcatcatcgcacccgattctttcaaagaaagcatgacatcaaaagaagccgctgacagcatagaaaaaggattcaaagcggtcttccctgacgcggaatataccaagatacccgcggccgacggcggagaaggaaccgttcaggctttgacggatgccactggcggaagcatcatcaaaaaaactgtgaccggtccgctgggaacgccggtaaacgccgcatatggacttctgggagacggacgcacggcagtcattgaaatggcggaagcatcgggactccatctcgttccccgccatctcagagatccgttgaacacaacgacaagaggaacgggtgaactgatagcggatgcagcctcccgcggggcgagtgagatcatcatcgggcttggcgggagtgcaaccaatgacggcggaacaggaatggcgagcgcgctcggtgtgcgtttcttaaatgaggaaggtcaggagatacatgacggaggaggcgctctgcacaccctagcttctattgatataagcgggctctcccctgatctgaaacatatccgttttcgtgccgcatgtgatgtcgaaaatcccctgaccggtgaaaacggcgcgtcatatgtcttcggcccgcaaaaaggggcgtccgagaagactaaagttgtattggatcgcaatttataccatttcgctgacgtattgagacgtcagcacgatatcgaagcggataccgtaaaaggcgcgggcgccgcaggggggctgggcgctggactgatcgctttcttacaggcagaaattcaaagcgggattgacgttgtattagatacactgtccttctcagatcagataagagatgctgaccttgtcattaccggagagggccagattgacggacaaacgatattcggcaaaacccccgccgggatcgccgcacgcgcagccgctcaagaaattcccgttatcgcattggcgggctccttaggcaaaaattttgagcatgtttacagcgcaggaataacagctgtattttctatcgtgcccggcgctgtaagtcttgaagacgccttagcatccggccgttttaacctggaaagtacagcccggaatgccgccgctctataccgggcagcaaaaaaggcgcgcctctagggcgcacctttttatggtttgatgacttctttatttcccatataaggacgaagcactttaggaatgatgacacttccgtcttcctgctggtagttttccaagatggcagctacagttctgccgactgcaagacctgaaccgtttaatgtatgcacatgctcaggcttgcctttcgcttcgcgtctgaaacgaatgttcgcacgtcttgcctggaaggcctcaaagttgctgcaagaagaaatttcacggtatgtgtcttggcttggaatccatacctcaatatcgtactttttcgcagctgtaaagccgagatcaccggtacacatgctcatgacgcgatacggcagttcaagcagctgaagcacccgctcagcttgatttgtcagtttttcaagctcctcataagaatcttccggcttcacgaactttacaagctcaaccttgttgaactgatgctgacggatcaaaccgcgtgtatcacggccggcggatcccgcttctgaacggaagcaggcgctgaacgcggcataattgatcggcaggttctcaccggataagatttcatcgcggtgcatatttgtaatcggcacttccgccgtcggaattaagaaataatcctcttctctgattttaaaagcatcctcttcaaatttaggaagctgtcccgtacctgtcatgctcgtacggtttaccatataaggaggaatgacttccgtgtaatcatattcatccacgtgaagatccagcataaagttgtagagcgcgcgttcgaggcgggcgcctaatcctttataaaacacaaaccggctgcctgttacttttgaagcgcgttcgaaatcaagaatgtttaagcggtctgcgatatcccaatgcggtttcggctcatatgaaaatgccggcgcctctccccacttgcgaatttcaatgttatcatcttccgtttctccgacgggaactgaatcgtgcgggatgttcggaatagacagaaggatggtttcgagcgtcgtttcgacagtacgaagctcttcatcaagcttcttaatttcttcgcctacttcacgcatctctttaataatatgatcagcgtcttttttctcccgtttcaaaacggcgacctgctgagacacctcattgcgttttcccttcagttcttctactttaccgataagctctcttctcttttcatccagctcttcaaacttgtcaaagtcagataagtcttcgccttttggaatgagcttcgcttttacctcttgaaaattggctctcagcaccttcgtatcaatcatgcctaacaactcctatctgtttttatcgaaaataaaaaagagccctcatcccctaaaagggacgagagctctcgcgttgccaccctgattgaaaacaagctcacacttgctttccgctttaacacataacggttttcccgtaaatgcctacttgttttcagcatttcgctcaaggacggattcggacagcatctttcaccgattcgcaccacccatcggctctctttgaaagaggggcttcctactgcttcctgtcaacgcttttcgatctttatttgtgattataatgtactataagtatcagcggttttcaactgttttatacagctgtttcctgcttatgcttttccgccatcttcacaaacagctctgtcacccggtgatcatccgtcagttcaggatggaacgagcagccgaggaaatttccctgctttgcagccacgatgcgtccgttatgctcacaaagcacttcaacatcttctccggcttttaaaatatgcggtgcgcgaataaatacacccgtaaacggctcatcaaggcctttaatcgtcagatcagcttcaaagctgtcgacctgacggccaaaggaattacgctcgacaactacgttcaacagccctaaatgagcgttatccgttcccgctatctctttggctaagataatcagaccggcgcatgtgccgaacatcggcttgccttgagcggcaaactcgcgaagcggctccataaaatgatacgtatccattaaacgccgcatcgtcgtgctttccccgcccggcaggattaagccgtcgatgtcattcagctgttcaggacgcttaatgacgacaccttttgaaccacatgcttcaattgaacgaatatgttctcttactgctccttgaagtccaagtacaccaattgttaacatgcttacagctctcctatggttttaccagccgcgttcttgcatacgctgttccggcaatagatttgagatttcgatgcctttcattgctgtgcctaattctttagaaagctcagcgatcagtttgtagtctgtataatgagtcgttgcttcaacaattgctttggcgaatttagcagggttgtctgatttgaaaatacctgaaccgacaaatacgccgtcagcgccaagctgcatcatcaatgccgcgtcagcaggcgtcgctactccgccggcagcaaagttcactacaggcagtttgccgtcacgtttgatctgaagaagcagttcataaggagcgccgaggtttttagcttcagtcatcagctcatcatcgctcatcgcaacaactttgcgcacttgcgcgtttacttttctcatatggcggacagcttccacaatgtttcctgttcccggttcgccttttgtacgaagcatggaagctccttcggcgatacggcgcgttgcttcgccgagatcacggcagccgcatacgaacgggactgtatattcatttttatttaaatgaaattcttcgtcagccggagtcagaacttcactttcatcgatgtaatctactcccattgcttcaaggacacgcgcttcaacgatatgtccgatacgcgcttttgccattacgggaatggatacagcattcattacttcttcaacgattgtcggatcagccatgcgggcaacaccgccggcagcgcgaatatcagccggaacgcgttctaacgccattacggcaacagctcccgcctcttccgcaatcttcgcttgttcagcatttactacgtccatgatgacgccgcctttttgcatttccgccatgccgcgttttacacgatcagtacctgtttgagccattatttggtccccctagtcaatgtatagttagataatgtctatctcttattgtatcccagaaatacaatatttcatatgggtattcttattttacagcgagatgaataagatagatatcatttttttactaataatttggttttttcagtatattaagcaaaagagccctaactttcatcagagctctttcttatttcttaaaaccagcctgttaccgtgtcaacggcgctgttccagataccggagaaaaatccgccgatgccgcgcatcatctgaacaaaccagtttgctttatctacatcatttttcgttacaagattcacgctgaactctttggatttgaggaagccatagtctttgtcactgcctttgtatgtaactgtcagcgttccgactttcgttccctttttcacaggagccgtgatttcttttttatctatagtcccttcggctttatagttcttttcatccccgcttttcacaggaatagaaagcgccttgtcagtaacaatatcgacttgcttgtctttccctttttcaacgtcaaccgttttgtgcccttttacttgagagccttcagggtaaagatctttcattgagaaattgctgttaaatgcgtaatcgagcatttttttcgtttcatcaaaacgtccggtatgcaggttgccttttgcgtttaatacaacggtgatgacccgcattccgttccgctgtgctgtgcttgtaaaacaagatcccgcagaatcagtagaacccgtttttaagccgtcaacgccagggtattcagaaacaagaccttttaacatgaagttccagttcggcatgtccatttcatcatcagtgccggctctgaatttcgttttagcgatgcttgttgttttgagaacttccggataatcagtgatcaggcggtctgcaagaagcgccatgtctttagcagaaacttcactctcttctttaacgccttctccttgcggctgtttgccgtgaagatcttcattcacaagccctgtggcatttttaaaatcatagtttgtcatgcctaattctttggctttcgcattcatttcagcgacaaatttcgtttcagttccggcaagaatttcggcaactgcaatcgcggctccgttagcagagtaaatcgccatggcctgatacagttctttaaccgtgtatttgccgtcttttcgaagggggacgtttgataaactgttgtcttgagaaatttcatagacataatcatcaggagtatacgtttgatcccatttcacttttccttctttaatggcttccagaagcagatattcagtcatcatttttgtcatgctggcaatcggcagtcttttgtctgcatttttactgtataaaatttttcccgatgaagcctcaatcattatcgcagctgatgcgttgacatcaatcgggtcattgccggctgcctccgctttagacatcggaacaaagcaagttgcggccagtgccagtaccactaatgacaccaacagctgtttccatttcgtgatgttcaatcttacgacctccgtcattcattttaaatctataattaagccgttaaggacatattcaaattcaaaacacaacagtataaattttatcacactcgatataaaaaaaatagacagagtcagcgaccctgtcaaatgttttttatttgtaacaattatgagattgtgtagtttggtgattctttcgtaatttggacatcatgcggatgactttcgcgaagaccggcacctgtcatacggatgaattgagcctcttctcttaaagcgcgcaagtcttttgaaccgcaatatcccatacctgaacgaagaccgccgacaagctgatacactgtttcttctacaggacctttgtacggagtccgtccttcgataccttcagggacgaatttcttattttcttcttggaaatatcggtctttactgcctttttccatggcagcaacagaacccataccgcgatacactttaaatcttctgccctgatagatttcagtctctcccgggctttctgaagtaccggcaagcaggcttccgagcattacggcatgtccgcctgaagccaacgctttcgtaatatctccggagaatttaataccgccgtctgcgataattgtcgcgccgtgttttctcgcttcagtggcacaatcataaatggcagtgatctgcggtacgcctacacctgcaacgacgcgtgtcgtacagatagaaccaggcccgattcccactttgacaatatttgctccggcttcaatcagagcttttgtcgcttcagccgttgcaacatttcctgcgataatgttcagttcaggatatgtttcacggattttcgcaactgtgttcagtacgcctctggaatgtccgtgagccgtatcaaccacgataacgtcgacattcgcttcaacaagcttgctgacgcgtgtcattgtatcgcctgtcacgcctaccgcagcgccgacaataaggcgtccgtgttcatctttagatgaattagggaattcgataaccttttcaatatctttgatcgtgataagaccttttaatttgttttggtcatccactaacggaagtttttcaattttatgtttctgtaagattttttctgcttcgtctaatgtggttcccacaggagccgtaaccagctcttcttttgtcatgacatcactgattttcattgaataatcagagataaagcgaagatcacggtttgtaatgataccgacaagcttttgatcgtctttattatctacgatcggaacaccggaaattctgtatttccccatcaaatgctccgcatcgaatacttgatgatcaggtgttaaaaagaagggatttgtaataacgccccgttcagaacgtttgactttgtcaacatgttcagcctgctgttcgatggacatgtttttatggataatgcccaagccgccctgtctggccatcgcaatcgccattgctgattctgttactgtatccattcccgcactgatgacaggaatattaagctttaacgtttttgtcagttcaacagataaatccacatcacgcggaagtacgtctgattgagccggtacgagcagtacatcatcgaacgttaagccttcttttgaaaatttactttcccacattagtaaatccccctcttttcggcaaaatattatatgtagattatcaactagaaaacagcatgtcaaggaagcgaaaaagagttgaaatatttagataaaggaaagggtttaaaaatacatatgagagatcatgagtggaaagagttatcattattttattccgtagaatcttcccagaaatttctaaacaaagtctatacagaaagcggcatggaagaaccaaaacgatatgcgtttaagaacagtgagcgcttcatattctttatcaaacacgccgagtccttttataagcaggcatctctttctcctttagaaattaagcctattctgttgttttacgggatgtcacaattgctgaaagcctgccttctgaccacagatccaagctacccaagccacgcttcagtactcgcgcatggcgtgactgcccggaaacgcaaaaagcaaaattactcctttagggatgatgaagtgaaggtgcagcgcaatggcttatgtattcatgtaatgaagcacttattcgggatagctggtcttgaggaagaacggtacacaatgaagaaattactgacagccatacctgaattgcatactgtcttttacttccaagagaaaaagaattggatgacccaagtagagctgaacgatgaccttatttcagtgcctgagcatgcggtgattcattacaatatgtctgattcccgctttgctgaatatatcagccatcatttgaagtggtcttttctgaggaaagaccataaccacttgttttttgaggctgacccgatagacagggaaccttggtcttctccaaatttattgtttcacttggagaaaaatcaatattacattccctctcagcgtgatcacttcctgcatcttccggaaatgattattcattatttggttctctacaatattgggatgattgcgagatatgaaacggagtggtggtatgaactgctgacacagcatgtcagtgatgattatgtgatgatccgacggttcttagaggtcacggaacgcaaatttccgtattacgtttctaaattcctgaagcaatacttgtaaacaaaaaaggcagctcatgatgagctgcctttaccgtaatgatagcttggcggcgtcctactctcacagggggaaacccccgactaccatcggcgctgaagagcttaacttccgtgttcggcatgggaacgggtgtgacctcttcgctatcgccaccaaaccattgagagtgttctctcaaaactagataacaataagtatacattcaaattggttaagtcctcgatcgattagtatctgtcagctccatgtgtcgccacacttccacctcagacctatcaacctgatcatctttcagggatcttacttccttgcggaatgggaaatctcatcttgagggggcttcatgcttagatgctttcagcacttatcccgtccgcacatagctacccagcgatgcccttggcagaacaactggtacaccagcggtgcgtccatcccggtcctctcgtactaaggacagctcctctcaaatttcctgcgcccgcgacggatagggaccgaactgtctcacgacgttctgaacccagctcgcgtaccgctttaatgggcgaacagcccaacccttgggaccgactacagccccaggatgcgatgagccgacatcgaggtgccaaacctccccgtcgatgtggactcttggggagataagcctgttatccccggggtagcttttatccgttgagcgatggcccttccatgcggaaccaccggatcactaagcccgactttcgtccctgctcgacttgtaggtctcgcagtcaagctcccttgtgcctttacactctgcgaatgatttccaaccattctgagggaacctttgggcgcctccgttaccttttaggaggcgaccgccccagtcaaactgcccacctgacactgtctccccgcccgataagggcggcgggttagaaggtcaatacagccagggtagtatcccaccgatgcctccaccgaagctggcgctccggtttccaaggctcctacctatcctgtacaagctgtaccaacattcaatatcaggctgcagtaaagctccacggggtctttccgtcctgtcgcgggtaacctgcatcttcacaggtactataatttcaccgagtctctcgttgagacagtgcccagatcgttgcgcctttcgtgcgggtcggaacttacccgacaaggaatttcgctaccttaggaccgttatagttacggccgccgtttactggggcttcaattcgcaccttcgcttacgctaagcgctcctcttaaccttccagcaccgggcaggcgtcagcccctatacttcgccttacggcttcgcagagacctgtgtttttgctaaacagtcgcctgggcctattcactgcggctctctcgggcttgcaccctaacagagcaccccttctcccgaagttacggggtcattttgccgagttccttaacgagagttctctcgatcaccttaggattctctcctcgcctacctgtgtcggtttgcggtacgggcacctctcacctcgctagaggcttttcttggcagtgtggaatcaggaacttcgctactataattcgctcgccatcacagctcagccttcacgggaaacggatttgcctatttcccagcctaactgcttggacgcggatatccaataccgcgcttaccctatcctcctgcgtccccccattgctcaaatggtgaggaggtggtacaggaatatcaacctgttatccatcgcctacgcctttcggcctcggcttaggtcccgactaaccctgagcggacgagccttcctcaggaaaccttaggcattcggtggaggggattctcacccctctttcgctactcataccggcattctcacttctaagcgctccacaagtccttccggtcttgcttcacagcccttagaacgctctcctaccactgttcgaagaacagtccgcagcttcggtgatacgtttagccccggtacattttcggcgcagagtcactcgaccagtgagctattacgcactctttaaatggtggctgcttctaagccaacatcctggttgtctaagcaactccacatccttttccacttaacgtatactttgggaccttagctggcggtctgggctgtttccctttcgactacggatcttatcactcgcagtctgactcccaaggataagtcatcggcattcggagtttgactgaattcggtaacccggtaggggcccctagtccaatcagtgctctacctccgagactcttaccttgaggctagccctaaagctatttcggagagaaccagctatctccaggttcgattggcatttcacccctacccacacctcatccccgcacttttcaacgtgcgtgggttcgggcctccattcagtgttacctgaacttcaccctggacatgggtagatcacctggtttcgggtctacgaccacgtactcaattcgccctattcagactcgctttcgctgcggctccgcatcttctgcttaaccttgcacgggatcgtaactcgccggttcattctacaaaaggcacgccatcacccgttaacgggctctgactacttgtaggcacacggtttcaggatctctttcactccccttccggggtgcttttcacctttccctcacggtactggttcactatcggtcactagggagtatttagccttgggagatggtcctcccggattccgacggaatttcacgtgttccgccgtactcaggatccactcaggagagaacgaagttttgactacagggctgttacctcctatggcgggcctttccagacctcttcatctacctcgttcctttgtaactccgtacagagtgtcctacaaccccaagaggcaagcctcttggtttgggctggtcccgtttcgctcgccgctactcagggaatcgcatttgctttctcttcctccgggtacttagatgtttcagttccccgggtctgccttctcatatcctatgtattcagatatggataccactccattacgagtggtgggtttccccattcggaaatctccggatcaaagcttgcttacagctccccgaagcatatcggtgttcgtcccgtccttcatcggctcctagtgccaaggcatccaccgtgcgccctttctaacttaaccgttaaaaagaatcactacgtgatatcttgcattactaattgaatgtgaattacttctgttatctagttttcaaagaacacgttggtggagcctagcgggatcgaaccgctgacctcctgcgtgcaaagcaggcgctctcccagctgagctaaggccccgtattgggtaaagatggtgggcctgagtggactcgaaccaccgacctcacgcttatcaggcgtgcgctctaaccagctgagctacaggcccatctaccatatgaaagaatcaaagttccttcaaaactaaacaagacagggaacgttctgtttataagacccaaggtcttatattccgttaaaatccttagaaaggaggtgatccagccgcaccttccgatacggctaccttgttacgacttcaccccaatcatctgtcccaccttcggcggctggctccataaaggttacctcaccgacttcgggtgttacaaactctcgtggtgtgacgggcggtgtgtacaaggcccgggaacgtattcaccgcggcatgctgatccgcgattactagcgattccagcttcacgcagtcgagttgcagactgcgatccgaactgagaacagatttgtgggattggcttaacctcgcggtttcgctgccctttgttctgtccattgtagcacgtgtgtagcccaggtcataaggggcatgatgatttgacgtcatccccaccttcctccggtttgtcaccggcagtcaccttagagtgcccaactgaatgctggcaactaagatcaagggttgcgctcgttgcgggacttaacccaacatctcacgacacgagctgacgacaaccatgcaccacctgtcactctgcccccgaaggggacgtcctatctctaggattgtcagaggatgtcaagacctggtaaggttcttcgcgttgcttcgaattaaaccacatgctccaccgcttgtgcgggcccccgtcaattcctttgagtttcagtcttgcgaccgtactccccaggcggagtgcttaatgcgttagctgcagcactaaggggcggaaaccccctaacacttagcactcatcgtttacggcgtggactaccagggtatctaatcctgttcgctccccacgctttcgctcctcagcgtcagttacagaccagagagtcgccttcgccactggtgttcctccacatctctacgcatttcaccgctacacgtggaattccactctcctcttctgcactcaagttccccagtttccaatgaccctccccggttgagccgggggctttcacatcagacttaagaaaccgcctgcgagccctttacgcccaataattccggacaacgcttgccacctacgtattaccgcggctgctggcacgtagttagccgtggctttctggttaggtaccgtcaaggtgccgccctatttgaacggcacttgttcttccctaacaacagagctttacgatccgaaaaccttcatcactcacgcggcgttgctccgtcagactttcgtccattgcggaagattccctactgctgcctcccgtaggagtctgggccgtgtctcagtcccagtgtggccgatcaccctctcaggtcggctacgcatcgtcgccttggtgagccgttacctcaccaactagctaatgcgccgcgggtccatctgtaagtggtagccgaagccaccttttatgtctgaaccatgcggttcaaacaaccatccggtattagccccggtttcccggagttatcccagtcttacaggcaggttacccacgtgttactcacccgtccgccgctaacatcagggagcaagctcccatctgtccgctcgacttgcatgtattaggcacgccgccagcgttcgtcctgagccaggatcaaactctccgataaagtagtttgactgactacgcacatcgctgtgcgatttatttaaaactttgaattaacaggtacgttttgtcttgtttagttttcaaagaacttttccgcccctctcgaagcgacctcttaatcataacattttcagtttgctaggtcaatacttttttaaaaaatattttcgctaggcttgcctttctattaaaaagacaacaaaaagaattatatcagcatcatcaccatgtgtcaaagcttttttttatttctttatatagtaaaagcgcagcctgttgcagctgcgctttttcgtttatacttcttccgtttcttccggctcttcttcattcttttcgacaagcgccacagtggctacatgctcttgatcagacatgcggatcagacggacgccttgtgttacgcgtcccgtagtggagatatcattaatatccattctgattaacacgccgcttgccgtaataatcattaagtcctcttcgccttttgttgctttcacagttactaacggaccgttgctgtcagtgattttacatgttttaaggccttttccgccccggctttgaactctgtattctgaagccggtgtgcgtttgccgtagccgttttctgtcactatgaggacatgggagtcttcttcaagaatctccatgcctacaacgacatcatcgtctgtcagcgtgatacctttaacacccgcagctgtgcgtcccatttgtcttacatcttcttcagggaaacggatcagcaaaccgttcttcgttccgatgatgatttgtttcttgccgtcagtcaggcggacggccatcagttcatcgtcttcccggagacctagggcgatcagaccgttattccgtatattcgcaaactgggacagtgccgtacgtttcgacaccccttgtttggtcgtaaagaagaggtattgctcctcatcaaacgtgctgaccggaataatggcattaatccattcgcctttttcaacttccagaaggttaataatcggaatgccttttgccgtacggccgtattcagggatttcatatcctttagaacggtataccttccctttattagagaagaacagaatcgtatcgtgcgttgatgtggaaattaagtgttccacaaagtcatcttcattcgttcccattccctgtacgccttttccgccccgtttttggctgcggtatgtggacgccgggagacgtttaacatagccgttatgggtcagtgtgatgacgatattttctctctcgataagatcttcatcttcaattgtttcaagaccggacgtcacgatttcagtgcgtctctcatcattgaaacgctctttgatttcattaagttcttcacggatgatctcaagaactctttcttcattggctaaaatatctttcagctcagcgataagcgcaacaagtgattgatattcctcttcaatcttttcgcgctccagaccggttaatcgctgaaggcgcatatccagaatagcttgcgcttgtttttcagtcagtgagaattgttcgatcaaacccgttctcgcaatttcagccgtctgggaattgcggataagagaaataacggcatctaaatgatcgagagcaattcttaaaccttccagaatgtgagctcttgcttccgctttgcggagttcgtaagccgttctgcgccggatcacaaccttttggtgatcaagataatgctccagacattgtttcaggcttagtaccttcggctgtccgtcaacgagcgccagcagattgattccgaaagacgtctgcagggccgtttgtttgtacaggttattcaaaatgacgtgagcattggcgtcacggcggatctcaatgacgattctcattccgttacggtcggattcgtctcgcagatcggtaattccttcgatttttttgtctcggacaagatccgcgattttttcaattaatctcgctttgttcacctgataaggaagttccgtgacaataattctttcttttcccgatgaagtctcttcgatttcagccttagcccggatcgtgattgatccccgtccggattcatatgccttgcggatgccgctccggcccaaaatctgacctgcagtcggaaaatccgggcccgggatgtattccatcagctcctggtttgtaatctcaggattctcacttacggcaagcacgccttcaatgacttccccaagctgatgcggggaatgtttgtcgccattccgaccgcaataccggcagccccgtttacgagcagattcggaaatctcgaaggcatgacggcaggctctctttctgaaccgtcatagttatcttgatagtcaatcgtgtctttcgtaatgtcacgcagaatttccattgcgatttttgacattctcgcttctgtgtaacgcatcgcggccgctgagtcgccgtcaaccgaaccgaagttgccgtgtccgtcaacaagcatgtagcggtagttaaaatcctgcgccattctgaccattgattcgtaaaccgctgagtcaccgtgcgggtggtacttaccgataacttcaccgacgatacgggcagattttttatatggtttgtcactggtcatgcctaaatcattcattgcgtacaaaatccgtctgtgaaccggcttcagaccgtcacgcacatccggaagcgcccgggatacgataacgctcattgcatagtccaggaaggatgtccgcatttcctgactgatattgacttcacgtacttgtggtgtgttttgttcactcattaaaaaaacctccctgaagtatcacatgaaataatgtgggagtagattgtccattatgatcttcaatacgatttcactattctccattatatcaataaacttgtgtttatacacattaatttagtagaatatacgggttttgcgggttttcagaggctttagaagccgctttgagaaaaaagccttatttcttaacgaaaataaggctttcttggttaaatatcaagatttttcacgtatctggcgtttgcttctatgaagtttctccgcggttctactttgtcacccatcagcatttcaaaagtctcgtcagcgtccattgcatcttcaagattgacttgcagaagcgttctggtcgcagggtccattgtcgtttcccaaagctgagtcgcgttcatttctccaagacctttataacgctggaggccgggcttaggtgattgcggaagctcttttaacagctcatcaagctgcttatcgttataagcgtattccacccgttttccctgctgcactttataaagcggcggctgggcaatgtagacatagccgttttcgatgatttcccgcatgtatctgtagaagaacgttaataaaagcgttctgatatgggcgccgtcaacatcggcatccgtcatgatgaccactttatgataacgcgctttttcaagattaaaatcttctccgattcctgttccgagggccgtgatcattgatctgacctcattgtttgagagaatcttatcaagtctggctttctcaacgttcagaatcttaccgcgcagcggcagaatggcttggaaatgacggtcccgtccctgtttcgctgatccgcccgcagagtcaccctctacgatatacagctcggaaatgctcggatctttagaagaacagtccgccagtttgcccggcagattggaaatctcaagcgcacttttgcgccgggtcaattcccgggcttttttcgccgccatccgcgctcttgcggccattaaacctttttcaacgattttgcgggctgagtccggattttcaagaaggaatgtttccagcgcagaagaaaacagcgtatcagtgatcgttctcgcttcggagttgccgagcttggttttcgtctgcccttcgaattgcggatcagggtgcttaattgaaataatggcagtcagcccttctctcacatcatccccgcttaaattcggatcattttctttgaaaatcccttttcttcttgcatagtcgtttatgacacgggtcagaccggttttaaatccggcctcgtgcgtgccgccttcgtatgtgttgatattatttgtgaaagaataaatattgcttgtatagctgtcgttgtattgcaatgcaacttcaaccgttatgccgtctttctcgccttcgatataaatcggctcttcatgaacgacttctttggaacggtttaagtactcaacatagcttttgattccgccttcgtagtggtactcgtttttccgttcttgtccttcacgtttgtcttcaatcgtgatgtttacgccttttgtcaggaaggccaattcccggacacggtttgaaagcagatcatagtcatatacagttgtttctttgaaaatttccgggtccggaacgaagtgcgtaatcgttccggtcttatcagtttcgccgatcacttcaagatcggccacaggtacaccgcgctcgtacgcctgataatggatttttccgtcacgatgaaccgtaacgtcaagagtggtcgacaaggcgtttacgacggatgcccctacaccgtgaagaccgccggatactttatatccgcttccgtcaaatttaccgccggcgtggagaacggtcatgatgacttcaaccgcagggcggcccatcttctcctggataccgaccggaattccgcgcccgttgtccttaacggtaatgctgttatctttttcaatctcgatgttaatatctgtacaataaccggccagggcttcgtcaatactgttgtcgacgatttcccacaccaaatggtgaaggcctttgctgttagttgatccgatgtacatccccggtctctttcgaacagcttccaaaccttctaatacctgtatctgattctcatcataactattttgctgctgttccatagccatgcacattcacctacacttttcttaaacgataatatattcattgtaaagatccgctaagaatctatttctaacataaattgcgcacgtttcttcagtgtgccggaagataagggagagtaatatatattctcagtcgtgactacgatagactttggcgtgccgtttacggacggcactactttttctttctgtctgtccagaaattcttcaacgatcggcgatacattgaccttgcagtcaaaaatgccgacgatatcgcgggttgaaacgacaaagtcgtcacctaaatgaatatacaatcgctcacctcatttcttcacttcactaacgcaccgttttccacacggaacattcctgcttgatgtaaggtatcgtggtcaatgccatccacgctcgtcgtggtgacaaatgtctgcacacggccttggatcgtatgaagcaaatgggactgtcggtaatcatccagctcgcttagtacatcatccaaaagtaaaatggggtattctccgatttcttcatgaatcaaatctatttcagccagctttagagacaaagccgtcgtacgctgctgtccctgcgaaccgtaagtctgcacatcgcgtccgttcacataaaaaaggacatcatcccgatgcggtccgaataatgtgacgcctcgttctatttctttttcttttaatttcgaaaaagactcctggtagctgttacctattttcgacaaatctttgggatctgatacatcaagcgccgtgtgatacttaagcgtcagttcttcaagtccccgggaaatgccggaatggatcggctgcgcccatttttcaagctgcgccgtaaactgcagacgtctggcgacaacttttgcggctgcttcaatcagctgatcagtgagaacgtcaagcatggtccggtcagtctgtttccggctttgcagctgtttcagaaaatgattccgctgtgaaaggattttttgataaagagataaatcatacagataaacggcagaaacctgcccgatctccatatcgagaaatcttctcctcacctgagggcttcctttgacgagatttaaatcctcaggggcaaacataatggtgttcagcgctccgacatactgactgagtttttgctgctctatatgattgaccttgccctttttaccttttttggagatgacaagctgcatcgggatgtccccgttgcgcttcatcactcttccttctattttagcatagtcttcgtcccaccgtataagttctttgtcatttgaggtgcggtgtgattttgccatcgaaaggacatagatggcttccatcagattggttttgccctgggcattttccccgatgatcacattcaccttgttttcgaattgaagctcagcgcgctcataattacggtaggatgttaattctaaattttggatatacaaccgctgtcacccgctttaattgacgacttgaaatgaaccaaatccttcaatcgcgaccacgtctccaacgtaaagctttctgccgcggcgattgtcaggttcattgttgacagtcacctcatgctcgctcagaaaccacttcgccatgccgccggactgaatcacatcagctaattttaaaaactggccaagcgtaatcatttctgtatcaatcgaaatcggatttgccataatatcgacctctttcaaatatcactaatatctaattgtactaaaaaatcctgaaataaggaaagggaaaacttgagggagcggctgatgaatagaaaagctgccgaactaagccggcagcacattctgtttgattaatacgttctgaccggaaggatgagctgaacgatggtctcatcattcggcgtacggataagaaacggtctcatcgctcccgtaaagctgatacggatgtccgctccttcaagtactttcagtgcgtccatcatatattttggactgaatgaaatatttaattcctcgccgtcaatcttgtctgccagcacagcttcgaccactttcccgatttccggagaatttgatgaaatctcaagcgaatccgccggtttggcagaaagttttacaacgttgttgcggccttctctcgccaataaagaagcacggtctatcgcctgtaaaaattccttcgtgttcacgacgatttccgttttgctttcctgcggaattaagctggtcgtgtccggatagtttccgtcaagcaatcttgagaagaacaatacgtttttcgctttgaacagaacttgggtttctgtaatgacgatatccaccagctcttggctgtcatcaagaattttgcttagctcggttaagcttttcccgggaatgaccacgttataagtactgtcttccggaatatcaagcttcgcctttcttaaagcgagtcggtggctatccgtggcagtgcataataattcaccgttttcaactttccagtttacacctgtcaagatggggcgtgtttctgaggcggacacagcgaacacggtttggcggatcaggtttttcaaaagatccgtcggaatctgaatggcgtgatgctcttcgatttgcggtagatgcggatattcatctgcatcaaggccgtttaaattaaattcggcttttccggaacggataatcgttaaatattgattttgaacttcgatttcaacagtcgccatcggcagttttttaacgatttcgctgaagaaacgcgcttgcagcacgatacttcccggctgatcgatcgtcacgatttctttatcatcatcttctttcggaatgaatgactcaattgaaatatcagagtcacttcctgtgaaagatactccttcatctgaggcgacgatcttaataccggtgagaatgggaattgtggttctggatgaaacggcttttagaacgtcttgtacactttcgactaaccgatctttttgaatcgtaaatttcatgtttatcctcctaacggataatataattaatatatttttaaaaatagcagtagtaatagtagggcctgtggatttgtggataagttgtgaaaaagacaggaaacacagcctatccacatgtggacagactgtgtatggctatgaaaaagttattcacactttccccgattcatccgaggacactattatttaagcagttcttttatttctttcacctgctgctgaagctgctcgtcatcaatcagcagttttgaaatcttttcgtgggcgtgaatgacggttgtatggtctctcccgccaaattcttccccgattttaggcaaagaagaatccgtcatttctcttgaaagatacatcgcaatttgtcttgggaaagccactgatttcgtacgctttttcgctttgaaatcttcaagcttaatgttgaactgctgtccgacaatccgctgaatctcttttatcgtaatgaccttcggcttagaagacggaataatatctttcaatgcttctgcagccaggtctgcgttaatgtctttattgattaaggatgaataggcgacaacccggattaatgccccttccagttcgcggatgttgctgtcaatctgattggcgatgtaaagcatgacctcgttcggaatatcaaggccctccgccttcgctttctttctcagaatggcaatccgcgtttccagatccggcggtgtgatgtctgtaatcaatccccattcgaaccgcgaacgcaggcggtcttcaagggtcgggatctctttcggcggtctgtcactggaaatcacgatttgtttgctttcttcatgaagtgtgttgaatgtatggaaaaactcttcctgtgtttgttcttttccggctaaaaattgaatatcatctatcaaaagtacatcaacgttccggtagcggttgcggaaatcaacggctttattatcgcggattgagttgatgaattcatttgtgaatttttcagaagacaggtacaccactttggctgaaggattatgatcaatgacataatggccgatcgcgtgcattaagtgggtttttcctaaaccgactcccccgtatataaataaagggttgtacgctttagcgggtgcttccgccacagccagtgatgctgcatgggcgaatcggtttcccgatccgatgacgaatgtgtcgaatgtatatttcgggttgagcatgctttggggaaaatcagacggttcctcttttgccgcttttttcacttgcggtttcggcaaaaagtcttcttcgtcctgattttgaggaatgacaaatttgacgctcaattcttccccggttaattcatatatggtatctgcaatgagatgtaagtacctggactccagccagtctctggcaaattcattgggagcggtgatggttaaggtatctccttgcagcgaatgggctttcgtcgacttcatccaagtttcgaaactcggtttgcttagctttttctcaatttgagctagagcttgattccaaagatccaatatattctccattatccggcacagccctccttttctttaaaaatcagcgcccttcccctgttatagaacacaaaaaaagagcatatggctctgaccattcgtacacacgaaatgttgaaaacatatagtatagtagaaaaatagcttttcgacaaattccacaagttgtggacaacaatctacacaagctgtgtgaaaacaatccacaacttatccacaatttgtggataaagagaatggactggataagtaattaagagttaaaacacaaatataatatcaaattaagcgaggacttgcaatggttctcgtaatcttatccacaaacctgacaacttgttgaaaaatctttgtccacaggggttagcaatgtgaaaatgttgtcgataacgattgtggatattaaaaaaagaccgaaaaattatccacatgtcgttttttcgggggagcgcggctttttttgtgcgttaaaaaaaggaatatgaaaaataaggtttctaatctggttaaggtatgttatcctattatggttgtaagaaataaaagcactgctgaagttgacaatgaataggcagcacaaatataataagtaagactgtctttaacagctattcctcgagggaggtgtcataaatgaaaagaacattccaaccgaataaccgtaaacgcagtaaagttcatggcttcagaagccgtatgagttcaaaaaacggtcgtctagtattagcacgccgtcgccgcaaaggcagaaaagtattatcagcttaggccactgaataatgtcagtggtcttttttcacattaagagaaaagagatgtcatgcgtcgcccggtactggagaaatttcttcagtattccggcggcccgttttttttagatagaaataaaagtttctgcgagtgaatatcggagtgaattaaagtgaagaagcgaaatcggttaaagaaaaatgaagattttcaaaaagtgtttaaacgcggaacgtctatggcaaaccgccagttcgtgctgtatacgcttgatcagccgaaacaggaagagctccgggtagggctttctgtcagtaaaaaaatcggcaatgccgtcgtgcgcaatcgggtgaagcggttaatcaggcaggcggttcaggaggaaaaagagctgctcaagccgaaagattttattattatcgcaagaaaacccgccggcgacctcagttttgaagaaacgaaaaagagtctgcagcacttattcagaaaaacctcattatataagaaatcttcgtcaaaatagctcatattttgttttcttcacgtttttaaaagcgcttccttttatttggcgaaaaatgaacgccatttgaaactgaaagatgctaaaatacatacaaggtttataaagattggtataggaggaaacgttcttgaaaaggagaatatggttactactgagtatggtcggtatgctcgtgctgctggccgggtgctcgagtgtgaaagagccgattacggcgaatagtccgcatttctgggacaaatatgttgtgtatccattgtcagaagtcattacgtacgtagcgaaactgacgggcgataactatggtttgtcgatcatcatcgttacgattttaattcgtctgctgattctgccgctgatgatcaagcagcttcgaagctcaaaagcgatgcaggcgctgcagcctgaaatgcagaagctcagagaaaaatacagctctaaagatcaaaaaacgcagcagaagcttcagcaggaaacaatggccctgttttcaaagcacggggtaaacccgctggcgggatgtttcccgatcctgattcaaatgccgattttgatcggattctaccacgccattatgcgtacgcaagccatttcacagcacagctttttatggtttgatttaggagagaaggatccttactatattcttcctatcgttgccggtgtggccacttttgtccagcagaagctgatgatggcgggaaatccgactcagaatcctcaaatggcaatgatggtatggattatgccgatcatgatcatcgtatttgcgatcaacttcccgagcgcgctttctctgtattgggtagtcggaaacctgtttatgattgctcagacattccttattaaaggacctgacattaaacacgatccggaaacgcagaaagccggaggaaagaaaaagtgaagaaggtgactgctgcgggacggaatgtcgaagaagcagttcaatcaggccttcaggaacttcaactgacgaaagatcaagtagaaataacggtggtgcaagaagaatataaagggtttttgggtattttcggaaaaaagaatgcgattgtagaactggaagagaaaagaaatcctgttcaggaagcgaaagcgtatttagaagaaatcatccattccattgccgggccttctgagattgttacggaagaaaacaagaaaacagtctgttttcatattaaaggtgaaaaagcggcgctgcttattggcaaaagaggacaaacactcaatgccttggaaacattgacgcagcttgttttgaaccgcggctccggccagtatcgccaagccgttgtcgacgctgaaaattatcggcggaaaagaagagaaattctggatcagctggcaaacaggctggccaagcaagtgtcgaaaacgaaaaaagaggtgcatttagaaccgatgccgtcaggtgaaagaaaaatcatccatgacgcgctgtcaaagcatccaaatatcaaaacgttttctaccggtgaaggccggtaccgccatctcgttatttcccataaagatagcagaaaaccgaagtccgggtaaaatcggaacttcggtttttttattggtaaaaatggctctattcctgagcagaatcgcattttttgcgtttaagttttttctttttaggtctatgctgttgataaaaaaggttttaggaaataaaattaattgttattcacatgtggataagttaaagtaataagggatgaatttctgcctttgtggataacgtatcttccacttcaaaccaaactatgttatcttttaattttggcgtaaataaaattttttatatagatggaaacagagataaagagaggtgaacagtatggatacaattgcagcgatttcaactccgatgggtgaaggcgcgattgcgatcgttcggctgagcggcccggaagccgtaaagatcgccgacaaaatgtacaagggtccgaaaggcaaaacgctcagttcggcagaatcgcataccattcattacgggcatatcgcggacagtacgacgggacggattattgaggaagtcatggtgtctgttttaagagcgcccagaacattcacaagggaagatgtcattgaaatcaactgtcacgggggtattgtgacggttaatcaggtgctccagcttgctttaagagaaggtgcgagactggcagaacccggtgagtttacgaagcgcgcatttttaaacggacggattgacctttcacaggcggaagcggtgatggatctgatcagagccaaaacggaccgtgccatgaatgtcgccatgaaccagatggaaggacggctttccgcgcttgtccgccgtctgcgtgatgagttgttagaaacacttgcccatgttgaggtaaatatagattatccggaatatgatgacgtcgaagaaatgacgcatcagcttttagtggagaaggcaagcggcgtgaagaaagaaatcgaggcgctgctccgtacgtctgagcaggggaaaattttgcgtgagggactgtctaccgtgatcatcggccgtccgaacgtcgggaaatcctctctgcttaacagccttgtccatgaaacgaaggcgatcgtaaccgatattccgggaacgacgcgtgatgtgattgaggaatatgtcaacgtgcgaggcgtgccgcttcggcttgtcgataccgccggaatccgtgagacagaagacatcgtcgaaagaatcggtgtggaacggtcacggcaggttctgaaggaagcggatctcattttgcttgtgcttaaccacagcgaagcgctttctgaagaagatgtgaaattgtttgaagcggttgagggaatggacgtcattgtcattatgaataagacggaccttgaggctaagattgacgctgagcgcgtcaaggaactggcgaaaggccggcctgtcgtcacgacctcattgctgaaagaagaaggcattcaagatttagaggaagcgattcagtcgctattttatacaggagcgatcgaaagcggagatctcacctatgtcagcaacacccgtcatatttcgattctgcatcaggcaaagcaagcgattgatgatgcgctgaacgggattgaacaggatgttccgattgatatggtgcaaattgatttgacaaggtgctgggaactgctgggcgaaatcatcggtgatgccgttcacgaaagcttaattgatcagctcttttcacaattttgtttaggtaaataaaagggaggaaaaaaccatggggtatgaagcaggccaatacgacgtgattgtcatcggcgccgggcatgccggtgttgaggctgccctcgcatccgcgcgccagggagccaaaacgcttgttttgacgattaatcttgatatggttgcgtttatgccatgtaatccgtctgtcggcggccccgcgaaagggattgtcgtccgcgaaattgacgcgctcggcggagaaatggctagaaatatagataaaactcatattcaaatgagaatgctgaatacaggaaaaggtccggccgtacgggcgctgcgtgcgcaggcggataaattccaatatcagcacgaaatgaagcatacgctggaaaaaacaccgaatttgacacttcttcaagggattgccgagcgtttaatcattgaagacggagagtgccgcggtgtcattacgcaaaccggtgctgaatacaaggcaaaaacggtcgtgctgacaaccggaacgtatttaagagggcggatcattctcggggatctgtcttactcaagcggtccgaataaccagcagccgtctattaaactttctgagcacttagaggagctcggttttgatctcgtccgttttaaaacgggcacgcctcctcgtgtctcaagcgattccattgattacagcaaaacagaaatccagccgggggacccggttccgcgcgctttctcatatgaaacggttgaatacattaccgatcagctgccttgctggctgacttacacgagtcctgagactcatgagatcatcgacagcaacctgcatcgttcgccgatgtattccggtatgattaaaggaacgggaccgagatactgcccttcgattgaagataaagtcgttcggtttaatgataaaccgcgccatcagattttccttgagccggaaggcagaaatacgcaggaagtatacgttcagggtctatccacgagtcttcctgaggacgtgcagcagcggatgctggcgaccattccgggactggaaaaggtgcagatgatgagagccggatacgcgattgagtatgacgcgattgtaccgacgcagctctggcctacactggagacgaaaaaaatccctaacctgtacacagccggtcaaattaacggtacatcaggttatgaggaagcagccgggcaaggaattatggcagggatcaacgcaggccgcaaagcgcttggaaaagaagaagtgatcctcagccgttccgatgcttatatcggtgtattgattgatgatttggtaacgaaaggaaccaatgaaccgtatcgtctgctgacttcacgggcggaatacagactgctgctccgtcacgacaacgcggatcttcgcctgacggaaatcggccatgagatcggcttaatttctgatgagcgctatgaagcgtttgagaagaaaaaagcggcgatcgaggcagagaaaaaacgtctctggtctgttattatcaagccgtctcctgagaatcaggaatatatccgttcactcggcggaagcgagctgaaagacggagtgcgcggcacagatttaatgaaacgtccggaaatgaactatgaaacagtgacaaaacttgcgcctgcagattctccggttccgcaagatgtggcggaacaagtggaaattcaggtgaaatatgaaggatatatcgaaaaatccttgcagcaagtggaaaagctgaagaaaatggaaaacaaaaaaatccctgatcggattgattatgacgccattaaaggaattgctactgaagcgcgtcaaaagctgaaagaagtgcgtcctttatcagttgctcaagcgtcccgtatttccggcgtcaatccggcagacatttcaatcctgctggtatacctggagcagggccgtattgccaaggtagctgaatagaaaggatgacggcatgaatatagagcaatttacatccagtttagcggagaaagggatttccctttctgaccgccagctggagcaattcgagttgtattaccggatgctcgtggaatggaacgaaaaaatgaatctgacatccatcactgagaaaaaggaagtttatctcaagcatttttatgattcgataacggcggcattttatattgattttgaaaaggtcaccactctttgtgacgtcggcgccggcgccggttttccaagcctgcccgtcaaaatctgcttcccgcatctgcatgtcaccatcgtcgattcactgaataagcggattacgtttttggaaactctctctgatgctttacaattagagcatacgacatttgtccatgacagagcggagacattcggacagcggaaagacgtccgggaaagcttcgatctcgtgacggcccgtgcggtggcgcgtctgtcggtcctgagtgagctttgtctgccgctggccaagaaaaacggtatttttgcggcattaaaagctgcagccgctgatgaagagctgaaagcggggcaaaaggcgattaaagtattgggaggagagcttgaacaagttcattcctttacacttcccgttgaagaaagtgaacggaacattatgatcattcgcaagacgaaaagcactccgaaaaaatatccgagaaaaccgggtactccaaataaatcgccaattgaagggtaatttagacagcctgatgtgacaattccatcatattttctgcaaaattgatgaagatacagcaggaaaaaccatgagaaaatagaattataaaaatggcagtttttaaaggtggtgtaggtacatgaagcattcattctctcgtttcttcgggtttggtgagaaggaagaggaaccggagatagctgagcatgatacaaacaaagaagagatactcgaaataccggtacatgctatcgttcccaaccgttttcagccacgcaccattttctcagatgaaaaaatcaaagagttagcaatgactatccatacacacggcatcattcagccgattgttgtcagacatacagaagatgaaggacaatatgagctcattgcgggtgaaaggcgctggagagcggtacagacgcttgaatgggagaagattcccgcaattattaaagatttttctgatacggaaacagcatctgtcgctttgattgaaaacctgcaaagggaagaattgtcctccattgaggaagctcatgcgtacgcaaggctgttagaacttcatgatttaacacaggaagccttggcgcagcgcttaggaaaaggccagtcaacgattgcgaacaagctccgattgttaaagctcccggaacccgtccaggatgcgattatggagaaaaaaattacggaacgtcatgcaagagcactgattccgctcaaacagccggagtttcaggtcacattgcttgcggaaatcattgagaaaagcttaaacgtcaagcagacagaagacagagtggtgaaaatgcttgaacagaataagcagaaaccaaagccgagacgcaaagcgttcagcagggatacaagaattgcgatgaatacgattcgtcagtcactgtccatggtggaagacagcggcgtcaggctgaacactgaagaagaagaattcgaagagtacatccagcttaccattcggatacctaaataaaaactctcctgatcagcaggggagtttttattttaatcaaaaaactattttgagataatgatagatttattgtgcactatacattatatatgtaaaattttatctttttgtgtcgtgaattgtctttttacagtcaaaaaagtcactttatcggagaacttatattagaaagtgtctttttcgtttacatttttttcacttgctgataaacaaattatgaaaaaaataaaacgctttactctttttttgataagatagaaacaagacagtacatgttcatgtgaaggtaggtgacatcgtgggaaaaatcatagcaattacgaaccaaaaaggcggagtcgggaagacgacgacttctgtcaatctgggggcttgcttggcttacataggtaaaagggttcttcttgttgatattgatccgcagggcaatgcaacgagcggattagggattgaaaaagccgatgtggatcattgtgtgtacgacattttagtagatgatgcagatgttacagatattattaaaccgacttcagtagagaacttagatgtcattccggccacgatccagcttgcgggagcggaaatcgaattggttccgacgatctcacgggaggtcaggctgaaaagagcattagaatctgtgaaacaaaattacgattacatgattattgattgtcctccgtctctcgggttattaacgattaatgcgcttaccgcttcagattcagtcgttatcccggttcagtgcgaatactacgctcttgaaggattgagtcaattattaaatacagttcggcttgtgcaaaaacatttaaataccgacttaatgatagaaggagtgcttctgacgatgcttgatgccagaacgaatctcggcattcaagtgatagaagaggtaaagaaatactttagagataaagtgtatcaaaccattattcctcgcaatgtccgtttaagtgaggcgccgagtcacggcaagccgatcatattatacgatccgcgttcgagaggtgcggaagtatatttagatttagcaaaggaagtggcagcgaatggctaaaggcgggctcggaaaagggattaacgcgttgtttaatcaggttgatttgtctgaagagacagtggaagaaattaaaatcagtgatttacgccccaatccttatcagccaagaaaacaatttgatgatgagtcattagctgaactgaaggaatccatcattcagcatggcattcttcagcccattatcgtgagaaaatcattgaagggctatgatattgtagccggcgaacgccgttaccgcgccgcaaaacttgccggtaaagagacagtgccggctatcgtgcgggatttatctgaatcgctgatgcgggaaatcgctcttttggaaaaccttcagcgtgaagacttatcaccgcttgaagaagctctggcatatgactcactgctgaagcatttggatttaacccaggaacagctcgctaaacggctcgggaaaagcaggcctcatattgccaaccatttaagactgctgacgctgccggaaagcatccagaacctcattgcagaaggtacgttatccatgggacacggcagaaccttgcttggcttgaaaaataaaaacaagcttgaaccgcttgtgaagaaagtggttgaagaacagctgaacgtccgccagcttgagcagctgattcagcagttaaacaacaatgttccacgtgaaacaaagaaaaaagaacctgttcaagatgttgtgttaaaagagcgggaatcgtatttgcaaaattacttcggaacaacagtcaatattaagagacaaaagaaaaaagggaagattgagattgagtttttctcaaatgaagatcttgaacgtatcctggaactattgtccgaaagagaagcgtaaaaaccatcttttttaaaaaagatggttttttatatacgtcttgtcagcttatgaaacggactgagccgttcctgccggccttctgatttatctgtcagctgtaacccctctgctaaaacatttgccatgctcataacaagatgaagcctcgtattctgcaggacaaaatactccataaacccgctgacattgacgattccattgatatggacgtcaccgatttcaggaaggtctttttgaacacctgctccgggcttcagcggcccatcgccgatttgaaatgagcctacgcttttgacgcggcctaaacaagcatcaaccgctataataaacggatttttatgtagatgttgaatatctttcagcttgtctttcatattgacggcgtgaacaggatctgacagcgtgccgtaaacgtgcaatctgcctaaattcattttttctaactttgttcctacgagcggacctaatgaatctccggtcgaccgatctgtaccgatacacacggtgactaacggtctgccggctgctttacgtaaagatgaagtaaggattgcttgtatttgattcgcagcagaagaatccgtatgggatacatattgttttgcccgttcttgagaaaaaagcccgccttttcgattcataaggttcacttccttgtcatgtcatacgagtattacattgttgtttttggtgatgtatggttgtttacagtatatccagcgctgcctttttttatgcttatgtcatgatgagcatgccggttgtttgaaaagagcggatagaaaaaagaactcagagcagttattctctaagttcatgaaagaaataagaccatatgatctacatcaacatattgctgatgatctaattccagcgctcttttttctgcagagaagaggataatcctaactgagcgcagagtttttttgcgggttccatttgttgaagtaacagagagatggagctgttctgtgtctttcatcttttttgcccggctgatggcttccgtcattaaagcttttcccgcgcctgaccctaggtgtttgggggaaatatacatagaaccgataaccgcaatgtgtcttagtttaaacagcagatgcttggagatcttgaggattcctatcaggctgtcttgttcaaaggcgccaagcaagatggcattgccggcttcaagcctggctttgcatttttcggacggcctcatagctgacggcgattgcgtccgggtgatcttttaaagctttgagcctgaatcggagtaaggctgggtatcacttgcggttaaacgcctgatgtccatgatttgagcgcctaacataaataaattttctgaatagtcaatcgtcgttatcataccatatttgtcccatttgtatgaatgtttgctgctgtcactcaatatagtagcaatatgcggagatgatcagaaattttatgaggtgatgagggtgtggagagccgggatgaagtggatgctgctcatattaagcagccagattggggccgggtatgcaagcgggcaggaaatatggcagtttttcggtgtcgaaagcggactggctattgtattgtttacagtcatgtttacgatttcggcttatattgtgttgaagatcagctatcgggttcaatcaacgcactttttacctgtgcttgagcatctgatgggaccggctcttgctaaagtctatgatgtgcttattatgttttatttgttttcaatgacgatggttatgattgccggcggcggtgtgacgctgcaaatgtacaagctgccgttttggatcggtatttttcttctttgcattgtgaccgtgggtttattcttttgggatataaaagggatattatctctgaatagtattttgataccgattcttgtagcggggctgttatatgcattggtcttttttcagacaacgcatcattacacgtggacgatagacttgacccgccagtataattggccggcaagcattaccttcacgtccttaaacattctttctgttgtcgctgttctttcttcaatcgggaaagatatgaagggactgggagaagccaaaatcgcaagcgttgcaagcgggctgattttcggtatgatttcatttgtttacaatgaaacgcttgtacagctttcaggcagtcttacacaatatgagattcctcttttcgccgtccttgaaggcgctccttatccgttatttctttgtatggccgccgtgctttttttagccatctatacgacaacggtgaccggtcttttcgggctgtccagccgcatgcttgcatttgtgaaattgccgagatggacgctcgtatctcttcttttagctgtgatggtgccttttacgacaatcggtttttcagatttgatcgccattttatatcccatttacgggcttttaagtctttatttgctggtatgtcttcttctttaccctattttagggagatggaaaaaagtataatgctcattttgagtgcggccgttgctcttatcctgtctttttttgtacaataaataaagcagtctatggagagaggtgaagggtcttggcggataaagactttggcctgaatgatattgttgaaatgaagaaaccgcatccttgcggtgaaaacaggtggaaaatcattcggatgggaatggatattcggatcaaatgcacgggttgttcccacagtgtcatgattccgagaagagattttgagagaaagctgaaaaaagtactcgtcaagcatgaggagcctacatcataagggctggcgctcatgctttttcatatagaggagaggaagaggcccgatgagcaaagtgcatcagtcagcgtgcccgctgaattgctgggacagctgcggctttttggtgacagttgaggatggaaaggtgacgaaagtagacggagacccgaatcatcccattacggaagggaaaatttgcggccggggcagaatgctggagacgaaaacgaatgcgccggaacggcttcgttttcctttaaaaaagaaagacggcgaatttgtccgcatttcctgggagcaggcgttagatgaaattgctgaaaaaatgacggtgattaaggagacgttgggcactgccgcagtgctgcacagtcatgactacgccaataacggtcttttgaaggcgctcgaccagcgttttttcaatggatacggcggtgtaaccgagattgcgggcagcatttgctggggttccggcattgaagcgcagcgctgggatttcgggcgttcttacgggcatggaccgcttgatatttatcacagcaagcatgtgatcgtatggggcagaaacgtgtcccggacgaatatgcacctctatcatcatctgcagcaggtgaagaaaaaaggagcgacactgacggtcattgaccctatttttaacccgactgcaaagcttgccgaccggtatatatccgtcaaacccggcatggatggctggcttgcggcgggtgttttaaaaatattatgccaaaccggcagaaccgattctgattttattcaaaagcattcggtcggttttgaggaaatagacaagcttctgcagacgatttcttttgaggagatcattgagaaaacagaaacgtctttagaagcgcttgaatatcttgccgatttatatgctgacggtcccgcctccacttttatgggtcttgggatgcagagatataaaaacgggggcgggacgatacggtggattgacgctttagctgcggcgagcggaaatgtcggtatcaaaggcggcggcgccaacttcggaaatgtgcaagtcggtgaaagctttgcaaaggccgagctcactcgtcctgatttgaagaaaagttcgagaacgttttcgatgatgactcaagctgaagaggcgctgaatgcagccgacccgccgattgagatgatcatcgtgacgtgcggcaatccgctgacacaggtgccgaatacaaaaaaagtgaaggaagcgtttgaaaaaacgccggtcacagtggccattgattcggtcatgaccgatacggcgaagctctgtgactatgtgctgccgacggccgttgttttcgaagaggaagatatttattattccagcatgtatcatcactatgttcaatatggtaagaagcttgcggaaccgcagggagaggcaaaatcagaccgctggatctggacggaactcgcaaagcgtctcggattcggggagctgtttgattacagtgcggaagatttcttaaaaatggggctctcttctttggagaaagaaggaatcacccttgagcaattaaaggaaaaaggacatatgccgcttccggttaaacaggttccgtggagtgattttcaatttttaaccccgagcggaaaatttgaattcgtctcgtcactggcagaagagaaaggatacagcggcctccctcaattggaagtgccggaggagtccgtttatcacgacgccggactggccgggaaatatccgtatacgctgctgtccattcacccgcagcgctccaatcattcacagcacgtgccgtttattgaaaagctccagcagattcaggtggacctgtcgccggatatcgccgaggagctttcacttcaagacggagatacggcagaggtatacaatgaccgcggccgtctgcgcggcagggtgaaaatcatgaagcaggctcacccgaagacggtgaatatagatgaaggcatgtgggcggcattcggaggctccgtcaacatgctcacaaaggattcaaattccgataatggaatgggaagtacgctttttgactgtctggtagcggttaaaaaagggtaatctaaggagagagagggcgggaaatgcttttttctcagcttgtcttttcctatgaacctccttataattgctctaggtttacaatacgtttatacgatgatggtttgatatagaggagatgaaagaatggctttaactgctggaattgtcggtttgccgaatgtcggaaaatcgacgttatttaatgcaattacccaggctggtgccgaatcagccaactacccgttctgtacaattgatccgaacgtgggaatcgtggaagtgccggatgaacgtctgcaaaagctgactgaattggtgaacccgaaaaaaacagtgccgactgcgtttgaattcactgatatcgcggggatcgtaaaaggcgcatctaaaggtgaaggactcggaaataagtttctttctcatatccgtcaggttgatgcgatctgccacgttgtacgtgcattcgctgatgacaatattacgcacgtgtcagggaaagtcgatccgattgacgatattgaaacgatcaatcttgaattgattcttgccgacatggagacagtcgaaaaacgcatcacgcgtgtaagcaagcttgcgaagcaaaaagacaaagaagcggtttttgaatttgacattctgtctaaattgaaagaagctttcgaacaagaaaagcctgcccgttccgttgaatttacggaagaacagcaaaagcttgtgaagcagcttcatttgcttacgtcaaaacccgtgctttatgtggcgaatgtaagcgaagatgaagtggctgatccttcagacaatgaatacgttgcgaaaatccgtgagtacgccgcgggtgaaaatgccgaagttatcgtcgtctgtgcgaaaattgagtctgaaattgctgaattggaaggcgaagaaaagcaaatgttccttgaggagctcggcatcgaagaatcaggtcttgatcagctgattaaagcgtcatactctcttctcggccttgcgacatactttacggcgggcgaacaggaagtgcgcgcatggacattcagaaaaggcatgaaagctcctgagtgtgcgggtatcatccacactgactttgaacgcggctttatccgcgctgaaacggttgcttatgaagaccttttggcaggcggcggaatgtccggagcgaaagaagccggaaaagtgcgtctggaaggtaaggaatatgtagtccaagacggagatgtcattcatttccgatttaatgtataggacacagttgtaaagggacaagagctttggtataatataaacttgtgagtaatagaattattgctccttgcccattatagggccgcttagaccaaaaggaggtgcaaacagatgaaaaagtacgaagttatgtacattatccgtccgaacattgacgaagagtcaaagaaggcagttatcgagcgtttcaacaacgtattgacttctaacggagcggagatcactggaacaaaagattggggtaaacgtcgtcttgcttacgaaatcaacgatttccgtgacggtttctaccaaatcttaaacgttcagtctgaagctgcagcggttgctgaattcgaccgtttagctaagatcagtgacgatatcattcgccacatcgttgttaaagaagaagaataagcaatttgaaatatataatgttaaaaggtggtctttcatatgcttaaccgagttgtattagtcggaagactgacaaaagacccagagcttcgttatacgccaagcggtgcggctgtcgccacgtttactcttgctgtgaatcgtacattcacgaaccagtccggagaacgtgaagccgatttcattaattgtgtcacttggagaagacaagccgaaaacgttgcaaactttcttaaaaaaggaagccttgccggcgtagacggccgactccagacaagaaattatgaaaatcagcagggacagcgtgtcttcgtgacagaagtccaagctgaaagtgttcaatttcttgagcctaaaaacagcggcggttctggatcaggcggatacaacgaaggaaacagcggcggaggccaatactttggcggaggccaaaatgataatccgttcggcggaaatcagaacaaccagagacgaaatcaagggaacagctttaatgatgatccatttgccaacgacggcaagccgattgacatctcggatgatgatcttccgttctaatagattatcgctatattcataacgagaaaggtgggaaatgacaatggcaggaggacgcagaggcggtcgtgcgaaacgccgtaaggtttgttacttcacttctaacggcattacgcacatcgattacaaagatgtagatcttcttagaaagtttgtttctgagcgtggtaaaatcttacctcgccgtgtaactggaacaaacgcgaaataccaacgtaaattgactatcgcgatcaaacgcgcacgtcaaatggctttacttccatacgtaactggcgagtaagccgaaagaaaagagcaagagcctgcgggctcctgctctttttttatatcagtcctcctccatcctgccgaaatgtttcacatgaaacatggaagtgctcctgacatctatctttgttatcttgctcctctattcaaatacgcgtacttatgcaatgaatttgtttatactgaagaacagggggtggctgagatggagacagacagaaatatcctgactgatgaaaagtggagcgcaatcatacgcaatgatgcttcttatgacggggcattttattatgcagtaaagacgacggggattttctgccggccttcttgtaaatcgagagctccgaataaagaaaacgtgctggtgtttgatacggctgatgcagcgcttgataaacattttcgtccctgtaaaaggtgccggccgaacggtcttcgtcttcctgatgaagaatggattgctcaaatcattgagtacattgaccgccattatcacgaatctctgactctgagtgtactggccgaaatgtgtcacggcagcccttatcatttacagcggacatttaaaaaaatcaggggaatatccccgattgagtatatacagaacataagattggcgaaggcggaacaccttttaaagcatactgatatgacagtcatggagattgctctgacggtcggaattccaaacacagcgcattttgccactctttttaaaaagagaaccgggaattcgcccacagaataccgaaaaactgccggaatgggacagggaggttcaatatgagtaaagagacaatggtctattggacacttttcacacggaatgattggagcctgtatacagccgccacatctaaagggctttgctttataggttcaaatcatggaagctttgaagagcttgagcagtgggcaaaaaaatcactgccgcaataccgattggcacgtgatgatgagaagctggcgtcttacacggcagagctgtccgagtacatcgaaaatggcagatcagctttttcagtgccggtggatctttacgggacagaatttcagcttgctgtatggaaagcgcttatggacataccgtacggcgagacatactcctattcggatatagcagaaatgattcagaaaccggcagccgtaagagccgtgggcgccgcaatcgggaaaaatccggtattgattacggttccgtgccatcgcgtcatcggaaaaaacggaaaactgaccggattcagaggcggtttagaaatgaaaaagcagatgctggcattagagggcggaaacattgaaacactggaatgccggctgagccggacaggggggaacacatgaaactgatttcttggaatgtaaacggcttacgtgccgtgatgaaaaagatagatatcaatacttacgttcaggaaacgaaagccgatattttatgtctgcaagaaacgaaagtacaggacggacaagtatcattacagcttgaagggtatcatgactattggaactacgcggtgaaaaaaggctactcaggcacggctgttttttcgaaagaaaagccgcttcacgtgttttatggactgggaattgacgatcatgatcaagaaggacgggtgatcacacttgaatttgagaacctgttcgtcgtcaactgttatacgccgaatgccaaacgcggattagagcgaattgattaccgtcttcaatgggaagccgattttaaggagtatctgcagaagcttgaccggaagaagcccgtgatattatgcggcgatctgaatgtcgcacacagggagatagatttaaaaaatccgaaagccaaccggaagaacgccggtttctcggatcaggagcgggaagcgttcagcgccctgctgaacaccggatttaccgactcattccgctatttatatcctgatcgggaaggcgcctattcctggtggtcttacaggacgaacgcacgtgagaaaaacatcggctggcggcttgattacgtcattgtttcagacagactgaagccgcggatcagcgaagcggccatttgcgccgatatcatgggttctgaccattgccctgttgaaatgacagtggatttatgatgagatagcagtaagagaaatccactcttgctgcttttttatcaccaaaaatggaggagcacatggcaaatataaaagagattgcgaaactggcgaatgtgtcggtggctaccgtatcacgcgtattaaaccgacacccgtacgtatctgaggagaaaaggcgtcttgtgaatcaagtgatgaaggagatggattatacccctaatcgaaccgccattgatctgattcgaggaaagaccaatacaatcggcgtgattttgccgtacagcgaccatccctgctttgacaaaattgtaaacggtatcacgaaggaagcgtttgcccatgattacgtgacaacccttctccccaccaactatgaccccgctatagagatgacctatttcgaactgctgaaaatgaaaaagattgacggactgattgtcacgtcccgcgcgaatgaatgggaaaccgctgtgccttatctggagtacggtcccattgtcgcttgtgaatatacgcagcatcaagagattccctgcgcttataatgacaggcaggcagcttacagagaaagctttttgtatttgaaaaaccgcgggcatcaagatgttgcttttacatgtgtgcgggaagcggaaaaaagcccgagtacggccgacaaggtaaccgcatataaggcggttttcggctctcttgatgaaacccgcattctgatcggatgccatgatatggacgacggaaagcgggcaggtgaacacttctggggtttccacaaggcgccgacggccatctatgcgcacagtgatgatgtggctgccggcttgtaccagtttgcgaaagaacagaaatgggacgcggagatcatcggcgagggaaacctgagcgtcagccgggcattgaatatcccatctctggaacttcatttggaacgggtcggaagggaagcatttttgctgtttttgcacggagaaacggctaaaaaacaaattatgcatcaatttcagcggaaaaagtcttgagctgaaatgggtttcatgctttataactagattgagaaaaaaaaaggaggcggacatatgcgaattgaacatgcggccatatgggtgaaagatttagaacggatgaaagaattttatgagaaatacttcggcgccaaggccaatgacctttatcataatgagaaaaaagatttcaaatcgtattttctttcgtttgactccggatgcaggctggaacttatgaaaaaaggcggcattgatgaagctccgtcacagaatatgaccggatgggcgcatctcgcattttctacaggcagcaaggagcgggtgaatgaattgacggagacgtttaaaaatgacggatttcaggttgtaagcggcccgcgcgtgacgggtgacggatattatgagagcgtgatagaggatggggaaggcaatttgatagaaatcacagtgtaacagtgcgggggaacccgcactgttttattgattaaatttgctgagcattagttttcggaccgaatagaattaacaaaacggaacatagaagccagcagccgccgatgaacaaaaagacgctgatgtagccgagcttaacggcaataaatccgacgagcagggatccgaatatattggaaaaacggccgagcccgtatgccagcccgctcccggccgagcgatattccgtaggatacggctccgatgtatatgcgtataagtttgaggtgaaaacccgttccgtgacattgacgacaaatccaaacacaataatcatgacgggaataaacgtcatgccgtataacagtccggcaatggcagtcagaaaagcgcttgcggccagaatccattttctttggaacgtctcggatatcatggaaccgagcaatgcgccaagcggtgcgccgacagagtgaagcacattgtaccacagcgttttttccatggtgatgccgttgcttttcagcaggctgggcacccatgaagcaaagccgtaaaagccaaaggtttcaagaatccataccgctgacaggatgatggtgatctttaaattcctgccctgaaacagccctaagtagcctgcgtgcttcactgtatgtacttctgccgcctcttttggcgcgggaagcgggcctttttctttctctatacgtgcttcaagacggttcataatggcgtttgcctgatcatatgcgccccgattttcgtgccagcgcggcgattcctcaagccggcggataaaaaagaaataaatgagaccggccgccccccatacgaatacgagccgccacccccatgagcctaaaggaatgacaaaagcggaaacaacgtttgtgacgggaacgccgatcagtccgatcatggcgcaaaaggagatgtattttcctcgtacggatgatggaaaaaattccgccaaatagctgttcgtcacaatcatggcggccgcgacgccgagcccggtcaagaagcggaaaatcattaaggacggaatgtcccatgccagcgcattcagaaaagatgagatcgaaaagacaaggacaaaacaattcagcgcttttttcctgccgatccgatcggacagtcttccgccgatggaggcgcctaaaaacatgcccaggaaggatgcggctgtgacgtcggcaatgacggacagcttcacgccccaatgctcaatcagcgccggagccacgttgctgagcgtaaacagatcagcgagatcgaaaaaatagatgattccgagagcggttaatacttgatagtgcacacgcgaaatggggagacggtctaatcggttcgctacatttgagaatgtctgatgtttcataaaaaaccccctgacttagcaattgtaatcagaaaatactgtaaatttatctgacgaatacattataaaggtctttttttggcaaaaacagagtgtaaataaccagagccaaaggaaacggcatagcgctttcttcttaaaatatataacatttcctatatctgtttctgtttatattgtaaaatgttgaaggaaaggaagttgatgcataaatatgaatacatttgtacggcccgcagagggaagaaatagtgtatcgagatatcttctttctctgttgctcattgtgggtttgttctttttcggaagcatactgaccgtgttttatatgtttctcacgtccgctttcaatccttcactgacgataaattgggatgaggcggcattaagtgacccgctggcggatatttatttacagcatatcgtctatttcatagcgattccgggcatttggatagcggttcgtttcattatgaagcggcggtttttatccatcattacaccgaatcagtcgctgaactggaagagaattttctttggattcggcacatatgttgtgctgatgtttgtcgcggggctgattgattttttaattcatccggatcgtttcacgcttcaggaattccatgcttcacgttttctgctgctgttagcggcggccgtcttgttggtgccgattcaaacctctgcggaggaatttctctttcgcggttttctgcttcagtttgccggaaaattgacggcaaacgcggtggttctgacggtcattatcggcggattattcggcgcacttcatttcggaaatccggagatggaaaatggagctctctgggcgggaatcggatatgttaccatcggcatgatctggacctttatcacgattaaaacgggcagtctggagatgtcccttggcggtcacgctgccaataatatgtttttatttatctttctcacagaggatcattcggtatacggcggcattccgtcgatatttacaacagcagccggcggctatgaaatatacgattgcatatcgactctggtgatcaacatcatcttcgcatggctcgcattccgttttgtgaaaaaagaaaagcagcaggccgcctaggctctgctgctgatttgtaaggtgttcatcgcttcatcaatatccgtcgtcggcctccggcaggcgaaattctcacaaatgtagaccgttgtcttcccatcgatcatttgataacccgcggcaaagtcagaaatgccggcaagctcatccggatgttctgcggcgagaatcgtataggcgggagtgaaatgctcctgaagcgcctcaatgaaacgttttctgtccgggtcatctttccttccgaacacaacgatttctttttggggcattgtgtgtgccagtacgctttgcatgaagaaagcgctgctgctcggataggcctctatttcccgtttgaacacggaaaacatcgcttcggctttttcaatcagtgatacatcacccgtcaggcggccgagacgaagcaactgtacggcagccgcgctgtttccggaaggcacggctccgtcataaacctctttttccctgacaagaagagtctcggcatcattccccgtaaagaaaaaacctccgtgccgttcatcccagaacagctccagcatgcttgtacataacgttttcgctttctgcagataagacggatgaaaacccgcttcatacaattcaaggtaagcccagatgagaaaagcgtaatcatcgataaaccctttgtttttcacttcgccctcgcggtatcggaccatgacgcgcccgtccggcatgaggtgacgttcgagaaagcggatcgctgtttccgccatgctgagaaagtcaggctcgtgaaatacctttgcggcttttgccagcccggcaatcatgagcgcgttccatgaggtcagcactttgtcatctgtatgcggatagcttctgttttcacgcgcttccagcaattttgttcttgcctcttcaaggcgttcggccagctcatgtccggtgaggccggtctcttcgaggatggcctcacgccgcgtgaaaatgaggtgcgggatgttttcgccttcaaaattgccttgatctgtgatgttatacaccttgcaataaagcgggccgagttcatcaccgagaagattcatgatttcttttttggaccatatgtaatatttcccctcacggccttcggtatcagcatctaaagctgagaaaaagctgccgtcttcatgcatcatttcccgctgaataaacgttacgatctgcatcgcaatctgtttgtagcgctcattacccgtgacttgataggcttccgtataggcggtcaggagaagggcgttgtcatacagcattttctcaaaatgcggcacgagccattcattatcagtcgagtagcgggcgaatccgaacccgatgtgatcaaaaattccgccgttcgccatgccgtcgagtgtcttggttacgccggccaaagcctgttccttgcccgtatagctgtagtagcgaagcagaaacatgagcatatgcggcatcggaaatttcggagcctggccgaacccgccgtacaccgtgtcaaacccgccggccagctggcgatacgtgtcatgaaccgcctgttcgccaagcatgccctcagccgggtgaatcttgacttcaagatgagcggcggcgttttcggcgatatcctcgacatgctgccggtcattcgcaaacgtttcggacagatgttcaagcacatcaataaagcccggacggttaaatttgctcgtcttcggaaaatacgtccccgcataaaacggcttctgatctggtgtgacgaacacgttcagcggccacccgccctgccccgtcatcagctggcagattctcatatacacggaatccacatcaggccgctcttcacgatcaaccttgatggctatgaatttatcgtttaacataccggcgatctcttcgtcctcaaaggactcgtgagccattacatggcaccaatgacaagtcgaatagccgatgctgacaagaaccggcttgttttcgcgttttgctttttcgaaggcttcttctccccaagggtgccagtttacggggttgtgggcgtgttgaagtaaatatggagatttctcagcgattaatctattgggtgtactgttatttggcattggatcaccttctttcacttttaaattggttgctatttttactttaccataatggagtttagtttataccttattagattaactagattagattttatctactcgtctaaggaacaccagtcattttgcgcacaatttttttgcaaaataaagacttataaacatttgctgtttcttgtaaagtggtaactaataaagaaataatgaaacaaacgatagaggtttagtacaaatttataagacgttgattatttatacaggaggagagaattaacaatggcatatttatatttattgctcgcaatttttggtgaacttattggttcctctatgctcaaggccgcagaaggcttcacgaaactttaccctactattggtgcaattattgcttttataggttcctttttcttcttatcacttgcaatgaagtccatacctttgaataccgcctatgcagtttggtctggtgtagggactattgctactacaataatttcgattttgatttggaaagaaaaaattaacattgccagtgttactgggattgttttgatacttgtaggagttgtaatattaaatctttttggacctggtcatggtgaagcacatagtgttgaaaacgcaagcgcaacaacaaacaatgaaaaaataattgagtagtgaactgtttgatagtgaagtctataaaacctcacttttttatttatagtcatataatatttgaatgtcatcatctttcatgaaaagtaaagtctcttcgtttttaagttgttcaattgcttcattgactgtttgatccaatttagatttgggtctgtccttttcttctctaccgaccaaaaaatcagtggatacatcatataaatcagcgagtttctttaatgtctccggatcgggcgatctataatccctttcgtaattagacaatgtctaccctgttaatccaattttctctgctggcacgtcttgattagagtaaccggatttttttcgagcccattttaatctttggcctaatgtcatttgttatcatccattccacaaagagttgattaattattataatatcagcaattgctgaccctttcataaagtagaacaaaaaggcgaacattaacctttgactctccgaatcggagggttaaacttaatctgtagttttattcattttgttgtctcgtccatactttcgtaaaaattctccgaaggcatcttgaagcacaaaaaagctctgactaattaatttagtcagagcttttttttatgaagtattcccgagtatctgtccttgtttttttaggcaatactacgtccaattctttatttaaccatgcgagcgttttattacgaagataattacgcatctgttcttctgcttcaagcattaccaagttaattgtacaagaagaattgctggattcacaagagttgcatttgtctcgataaagtagaccattgcttacaatatttttacattggaaaatgggttttggtccttcaacagcctctattacatcccaaaaggaaatatcctccggggattttgctaacctatatcctccctttacaccagggacagaatttacaataccagctttagataatttaccgaaaacttttgaaagaaatgtttctgaaagtccttggaactctgcaaggtcccgaatcccgacactttccttggagggaacatctattaaataaaccagacaatgtaaagcatattcaaccccaacactgtactgcatataaactcacctgcttttgattttaaggtttatcacattgtatcttaggagtatttttgatgatagtcaatcttaaaacccttcttcagatactatttgttccgtttgacaaaataaaatacaaggtttatattagtgaccaagttaatcgtcgattaatatagtctttaatataaaatgaaaggagagtttcaaatgagcaaaacacttatcattaacgcacatccaaaagtagatgatacgtcatcatacagtctacgggtaatgaaccactttttagaggcttacaaagaattaattccagagagtgaagagcttgagcaaattaacttatatagtgatgatgtgcctatgattgataaaacagttttaagtgcatgggataaggcagaaaaatgcgaagaactgacaagcgatgaacaaaaagtaacaggacgcatgacagaagtattgaaacaattcaaaagtgcaaaaacgtatgtcattgttttgcctttgcataatttcaatattccatcaaaattaaaagactatatggacaatattatgatcgcacgtgaaacatttagatatactgacactgggtcagtaggtctgcttaaagatggacgaagaatgcttgtcatacaagctagcggatcaatttatacaaatgatgactggtatgaagaagttgaatactcaaataaatatctgaaatcaatgttcaatttcctcggtattgaggattatcaaattatccgagtgcaaggaacagctttactgagtccggaggatgttttacaaaaagcaaataaagaagttgaagaagctgcttcaagattggcaggtaaataaggtatagcatgaagatcattgttgctgggggactgcagtaattggtcggtcccttcttcctaaattaatacaaaacggccatcaagtatttgcattgacccgaggtaaccggtcgaacacgttcctcaaaagaataggggtaactcctgtaaaagcagatgcaatggatcgagatgctgttcttaatgcttttaggaaaatttaacctgaggttgttgtccatcagtttacctctttaacaggttacaatcttgaagaaaaagcgagaatcagaattataggtgcgcgaaatactgttgatgcgtgtcatgaaattggagtgaagaggataattgctcaaagtctttcttttgcttatgaacccggattaatacctgccaatgaagacgtccctttagatctcgacgcaccaaatccaaggaaaataaatgtaattggagtggcatcattagaatcagcagttgctgaattacccgatttagtaaacaacattaaaacattgcaagaaaatgggttgaacaatatctcatttgaagtaaatcatgacacgttagagcatctttccagcgtgtttttttatttgtgaaaatgaaaaacctgtcaagaaacaaaagacatacaataatcgcaataaaaacgaaaagaataatttaatcaatagacactttgtacctttttacattttaactttgtcaataaatgttcaatctgccatgtaaattttcaaaattctttacgggagtgggggaatttgcttgcaacaagttttcttgaacaaaggtaacgcccacaaccccgtaaactggcacccttggggagaagaagccttcgaaacccaagtattaaaaaggagaactgcttatgactctattttcagggttaaatgtcatctgctttattgctttttagataagaaataaggatttaaaatctttatctttttatttactgttagataggtgaaacacaccccggcgactgtaaccatcccgcctgtcagtgcaataaacgcaggtacttcacctaaccacacccaagaaatagccaaggctacggctggtgttaaataaagtgaaatggctgcttctgaagcaccgacgagtgaagtgacatacgcaagtgcaaagtaaggcacaaccgttggtaataagcctaagtaaacgacagaccatgtggaattcatcgatgcgtgaacaacttctccccataaccccggaagaaataccagcattggcaatgtcccgccccaaatagtgaatgtaacgaatgggataaatccatatttttttatatagcgggcttgaaaaacgaaataaatactctccgaaaaagctgccagcaagattaacaaaatgccgttcactgaatttgtatagtttcctgccccaaatgaaatgatcgatacacccaataaactaatgatagagccgacccatttataaaaaccgaaatgttcaccaaaaaacagacgggataacattgcagaaaaaataggtgtcatggtcacgagtaagcttgctacccctgcgctgacgtttttttctccgatattcagcaaaatgtgatatagtgcaaaacctaaaaatcctaacgataaaatagcagggatatccttcatgtcaggcaaacgcatatgagtcaaaacagcaaaaaccaccaatgccattgacccaatcaacaagcgaaacaaagcgaggtgttccggcgtgtaactctccaaactcgcgcgaattcccgggaaagctgatgcccacaacccaatcatcagactgtaagctatgccgattcgaactgttttctttctcatctttctcactcctctttacaaaaaccaaccagttatttaatgtttttctatattaataaagatttgatgagatgacttcaaccagttaaatagattttgacccaaccactttaaggaggacccttttaatgagcgctccagaagaaaaaaagatgagaaagcttcctaagtacatacaaatcattcaatttataaaagagaaaataggaaatggagaatggccgatcggaagtaagattccaagccagcgcacgcttgccaaacactttgaggtgaacaggagcacagtcattacagctttagaggaattgacggcggatggattaatcgaaggcagaatgggcaaagggacagttgttacgaacaatacatggacacttttggctaagaattccgctcccgattgggatcagtatgtaacctccggaattcagcagccaagccaaaaaatcgttcaagagatcaataaatcagaatcaaattctgatcttatacagctcagtaaaggagaactttcacatgagatttttcctttagctgttatgaaagagatcatgggaaaggtatcccaaaacatagaggcattcggatatgaggaaccaaaaggatatttgcctttgagagaggcattaagcggctatttaagaacaatcggcattcaagcttctccttcttccattcttattgtttcgggcgcactgcaagccttacagcttatatcaatggggcttttacaaaggggatcgaccgtttatcttgatcagccttcctatctttattcattacacgtatttcaatcagccggtatgaagctgactggagttcctatggatcatgatggacttttgccggaacatatccgcatggcaaggggagaacgggggagggctatcttatatacaaatccttgttttcataatccgacaggtattttaatgtcaaaaaagagacgagaagaaatccttgcggcaagtgagaatacacagcttcccattattgaagatgacatttatcgtgagttatggatagatgagattcccccggatcctattaaaacaatagataaaaatgggcatgtgctttacataggcagtttatcgaaaacattaagtccgggcttgaggattggctggattgtcgggccggaaccagtgattgaacgtttatccgacataaaaatgcaaacagattacggctccagttcgttatcccagagagtagcggcagagtggtttatatccggtgaataccagcagcatctagaacaggtgagaagtcaattaaaggtgagaagagaattggccttgagtgttttagaaactcatttgaaagatgtggcgacatggaatatcccaaagggaggattctttgtctgggtaaaaatattgccttccatatccgtgaaattactttataccaaagccttatcaaaagggattctgctcaatctcggcaggatctatgctgaggaaaaagggagttatattcgcttatcatatgcttatgcatctcttgaagaccttcaaaagggaatttatgaattgggtttgatgattaaggaattggcaagcagataaatttatcataattactttaatagaaagagacatgacaccaatgacacgcggattgttcgctgactacggttggggtgctggttaaaaaatacttaggagaacttgatattcaaagagctgtaagagagagattatctttaaaaccgtcactagcagaagtcttcaaaattatttaagttaatataccggtctttattgagatttgttttaaatatgcatttgaaggtcaattttatgatgactaagaactaagaattacactactttataaccgtaatttattaatgaaatatttcctgaaaaactttgatttttaattgcagattgatataataggtttgttattcttggccaaggatgagaatatttacaaatcttcaaaaagtggtgttagcaattaaaaaacctcatattttattatttatattaatttttacattaggtttttttgcgtgctttttattcatttttaagcatatagagagaaatgaaacagaaaaaattaatcataaccgtgtacaagaagtaccatggggagtgaaaaaaatcaatgctgcttcaatatggactttaagagagaaacagaaagtgaaagttgctatattagacagtggtattgataaagagcataaagatttaaaagggaaaattaaaggggaatttaatccaataaacatgactttaacctcagatgatgatgtggggcatggaactgctattgcaggcattatagcagctaaagataatagctttggattagttggaattgctccagacactgagatatattcagttaaagtactaaattcagaaggaaaaggttcgctagatacccttgttaaaggtatagagtggtgtattgataataatattcaggtaataaatttgagttttggattaaccaaagataaaccgttgttaagaggtgcaattgataaagcagtaaacagtgggatcataatcgttgcagccgcaggtaacaattatggcggggatgttgattatccagcagcttatgaaaaagttctctctattaatgctgtagatagaaataataaactagctaacttttcacctaaaggaaagattgacttttctgcacctggtgtagatataccgatactatccctcaataatggatataaaactgaaagtggtacatctttagcagctgcacatgttaccggagtaatatcattaattttacaaaatagagataaattcggaattgattcaaaagaggatatttataatcaagttaaccgtgtattgtccaaattgtccatcgatcttggaaagaaagggagagatgaaatttatggaaaaggatttttatcttttaagtaaaggggctaatttcaatgaaatgttttaaaaagagtattgctgtttttttaagtctaatattaacttttacttttattttacataatgaatcaaaagctgaggctataaacaataggtattaccaaattgtaacaaatgatgaagagaaattagtaatcacagcagaaaaaggcggagttaaaggtttaatgactttagataaagaaaatatgaaactttcattaataaccgatgaaacttctcagaagactggagaaaaaggtaaagaatataaagttgatattgaaaatgctacaaatgagaagatagaagcaacttttactgatacggaaacaaataaaaagtatgagattaattcagatgaggtaacagcttcttttgtttggtttatacctataggaatagttattggagaggcacttttagcgcatttaatttcaattggattagctgtgactatttcaggagtgacttatgttgcctattctgagtttaagaagcgtaaaagaacctattctcattatatggcagtaagaaagtctaaaggattatttatcggtaatggtttgaaaagacctgctgcaattgcacgccttaaaaggggtgatgacacttggtctacgtcgaagaacaatgccaaatctattgctaaagccgcaagtccgattaaaaaaattgttggtccggagatagataaaaagggtaaaggtaaacattatcattatcactcgatctctaggtataaacatggaaaaggtgtccgtatgaaagctcatgctttctatggggcagcaagataatttagattaatttataaacacctaactttaaagtaattaaaagataggaaattataataggagaaggaggtaactatgttaattattgatcacaacccaaaggatcagctgtattcagagttaattgatttggctttcgagatttgcgacgaatttcatttagttttaagaaaagatatgggatctttaaaatcattcgatcctctgttaaaaaaacttgaaagttcgttaaaagtaatgaaagagcaatcagaatgggccagtaccattctaggagacaatcaaaaagcaaaagtttattactattatacagatgaaaacgcaaaaaacattctgaaagaatccgcaaattctttatattcttgggagcagccacatttaccagaagacttgtctttttttaaagatggaaaggagtggttggtaacatgctctcatgaagaagaaagttatatcgatactgaagatgataaagaaatacaaagaatattgagtataccaggattaaaagtgcattttgaaagatgggattaaaatcattcaattttttataaaaaaattgaatgattttagtgaataatatatataagtaaggaaaccgtatagaatggtttccttacttattaaaccaacattactcaattgggatttttcttgtttatttcttgactaatacatattgtttatcttccaaatagaatatatgactaaggtgatttatatctttaaactttatatgttttccaaattgtaaagtatttaaattgataactacacccatgctttcatctttatcttcatcttcatatccatctaagcaggaatatatttcaattgattcaccttttgacaagtgtttttcaatgaaaagaaaaagtgatttaatagatttacgttggccaggtgtattgttggcatgtaagtacccttgtaattcatatatataaggatgtgtgaatttgtttctgactgcttcatatccaggatctaaatgaacaatatcaattccgtatgcatcttcttctgtgtcataaacctttacaagtgaattttcactgttctttcgattgtttttaaattgagagcgtttgttgacatctccttttatttttagttcagaaatgggcttaagtgtaggattactgccatactcaccaataggaagttctttatccgccccaataaaatgatgtaaagtcaatctatttcctcctttatcttatacaactaaaaatactcaatctgactttggataatgagatcttttttgtgtgtctatgataccccgtgtttcttgcctcatcaaggcttgataatgtttgaaggctgaagatggatgatgtgactgatttttaggctccttagggaaagaggaaccgaattaatttaatttaattgttatattgttgacgcatactccatcaatgtccatttagatggtatttttacagctgcagatttttcttcgactatttctaatgttctttcaagttgattatatatgtatccggaaaattaagtataccgtttgaccaatttcagcgttatgaagatttcgttgccagaataccaacaattgaagataaattgaagcagaatagtattaattctaaaaagtgcgggcgcattatggggagaggggaatcttacacacttatctgcagcttcacccacatactttgtgaaagctccaacagcttcttcgcattctgcaagacaacaactattccgttgctttttaacattttcacattacaggattcaggataaaaaagccgccaacagggcggcttttcttaagttaatataccaaatatatatcaaacttcaatctgtatagctatgtctttcctaaaaaaccatcggcttggttcttgaagagtaaatcatttaacccaaagcactattactcctgcagatgaaatttagattattgggctgtatagccgccatccattacgacggcctgccctgtaactccattagctttgtcactggcgaggaatactgcgtaatcagcgatttcttgcacggctaacaaacgtttttgaggaaccaaggggtaaatgacttcttcaaacaccttttctatagaaatgcctctagtctctgcaatatcttgtaactggttttgtaccaatggagtgtcgatatatcccggacacaaggcattgacagtaattccgtattccgctccttctaatgctgatactttagttaaaccgatcaaaccgtgtttagcgctgcaataagctgctttccctgcaaaaccaattaaaccatttatggaagccatattgatgatgcggccaaatttttgttttttcatcaaagggaacgctctttttgtcgcactaaaaggagcagtaatcattaatttcagcataaattcaaatttatcagtcgggaagttttctatatcagacacatgctgaatccccgcattgtttaccagaatatccattcgcccaaaggtttcaagtgtcttagagaaacttttttcaacttgttcttcgtttgttacatcacaaaccgcaggcaggacttcatatccttgtcccttaagttcctcagctgcatgatgcacggctttttcgttcaaatcggaaattaccacttttgcgccttctttagcgaattcacgtgcaatttctaaaccaattccgctagccgcgcctgtcacaagagcaactttactttctaataatttactcatagtaacccctccaggaaacattttggtctcctaaaagtttacacccggcagttgtataagtaaaatgaataaaaagaatataatgtattcgttaaactcatgaaatggagatcatacgatggatatacgccaaatcacatactttcttgaagttgctaaatccaacagttttactaaggcatcagaaaatctgcatttgtcacagcctgccttaagtaagatggttaaaagtttggaagaggaattaaaggttgatctcattgatcgatccgctagacaaatcgctttgacagatgcgggcgaaattgtatttgagcaaggccaaatgattatgaagtcattagatgacttgtcgacgaacttatacgatcttttgcatttaaaaaaaggaaaagtgaaaattggaataccgccgctgatcggtgtcttgttttttcctaaaatcattagagggtttaaacaattgtatcctgatgtgaacatcaagctgatagaacatggaggaaacaaggtgaaaaaggaggttgaagatggagtactggatcttggcgtggttattgaaccagtggacaaagagcagtttgatatcattccattgcttaatgaagaactgatgctcttcgttcattccgctcacccgcttgttcataaagagattgtggaaatgcaagacttgaaaaatgaacctttcatcctgtttagtgaagacttttctcttcacgatcggattattcaggagtgtattagagccggttttcgtccaaatattgtttatgaaagttctcaatgggattttatcagcgaaatgattggagaagaactaggtatttccattttccctcagtcgatagtgaaaaagactgatcaaagtttagttaaggcaatctccattgtcaatccatccattccttggaaagtggcgattattttaaaaaaaggaaaatacgtttcacacgcagtacgcgaatttatccggtatatttcatctttttgtaagagtaattacgtagactaagatcactcatgaaaaaaatgaatggtttttatagtttttatgtattttacggttagagagggctgcgatatattatcttatgtcaggaaataagtacctttcaggaggaatttcaaatggatcaaagccgttaccagcaaggtttagacaaattaatggagtacactttaacaaacgatgataaaatttctacgcatttaaagatttctgaagacttgaaagatatcgctccagatgtaagtaagtacattatagaatttgcttacggagatatatattcacgaccgggattaaccaatcaacaacgtgcgcttgttaccatttcatcccttgtaacgcaaggaaccgagccgcagcttgaacttcatatcaatacagggcttacatccggattaacaccgactgagattgtagagagtatcacccaattggttccttatacaggcttcccgcgtgtacttaatgctctttcagtagctaagaaggtgtttgcacagcggcatgtagaaagccattgagaaataaagagcttgtatggaatgcgggatgaagtagtataaactcatcaatagaatatacacaaaacgacagcctataaggctgtttttaacacaaatgtctgacctcttttttgttttcggctgatcatatgtaaaagcgattatatgaatcgctttttgatacttagaaacatgctaaccttcgacctctttatcagtaagcacttttaaagcatttcttacttttaaggcgaagttgacaggtttatcaatcgcttcgaaatgaatatacatcagtctcggtttgtcaaacagccagtgattgtgtagagacgttacaatcagatcatgtttccgaagagcgctgataaatggattgatttctttttgcagaattacagtttctccgctgcaaagagcacggccgtcttttgtcattgattcaaatgaaaacatttgcggaatgagcaaaaatgatcttccgggccgtcccagtacaaccggttttatattcgttcgtgatctcattactgtacaaattccattttcaaacgtatgcatggttccgcccagaatatcgttgaattcgtcacaaagaccatgccgttcaatcatttccccgtcagtttttggtaccgcacgcacagttttagtagtcagaactcttagggcctctcttacttttcttgcaaaattgagaggtttgtcaattgattcaaaatgcataaacatcagacgcggtttatcaaacagccaatggttatgaacggcagttacgatgataccgaatttgcgcagttcactcattaatgggttcacttcttcttgcagtaaaacagtctcacctaaacataaggctctgccttccgagtccatgctctcaaatgaaaaggcctgaggaataaaaggaaatgcctcggctcttcttccgagtaccaccgggtgaatgttgcttcgaaatcttgtcgccgtacatacgccatttacgacactgggcgttgaattgagaattcttgcaaattctttgcagagtcgtgatggctccatactcgtttcttccacttcatatctcctcctgaaatcaatttaaacgtacttaatagtaaagatatgtgaagatagaaaaaatgtaacgcggcaggagtccataatagagagaatcagcttttttcaccatctcttcaactgttaattattaatagattttaatcggactatttaagatgtgataaaagccttccggatgtgtttgtccattcagtttacattgggtgatgcctttttcttttaccatgttttctcattcgcttatgattactttgcccaacccgtatttgcggtaaggcttcaggatgcagattcgttcgagcttgcctgtttggtttacgatgcggatccgtcctgtgccggcaggctgattctcatgataaaccaagacatgcccgcactgttccccaagcgtatcgaactgatcaaattcatcggattcaggtacttgctgttcctcaatgaatactgcttttctaatctcaagcgctgcttgtaaatcaatttctgttgtatcctcatgatcaaccaacccttttcacatattagtctggactgcacggcttgcttgtggtcttatagaagtaacgacgaaacatttatattgcaagtgcaacaaaaatatgaagggtttgaaaagatatgactgatattttgcgtgaaatcggcatgatcgcacgggcattggattccatcagcaatattgaatttaaagaattagacttaacaaaagggcagtatctctatcttgtgcgtatatgtgaaaacccgggagtgatacaggaaaaactggcggaaatgattaaagttgaccgaacaacagcggcgagagcgatcaaaaaactggaaatacaaggatttgttgaaaagcgtcctgatgatcaaaataaaaaaataaaaaaactgttcccgaccgaaaaagggagaaaggtttatccgttattgcaaagagaaggagagcactctgcggaagtagcactgtccggctttacgtctgaggaaaaagaaaccattttcagccttcttcagcgggtgagaaaaaatatagagcatgattgggaatatgtgaagaagggaaacaaaagagactattaatggatgataattccttttactgaatgattgcgttgtgaatgattaaagtcataaatggatacgttatctgtgaaatctccttcctcggttcctgcttcaactagccgataggcttatttttaacgaaaagtatcaattatggtatatttaaataagacaaaataattgaagcggggaatgatatgagtacaatcgaaaaacaaagacgtaagaaattcagagccaaatcaatcgtacgggtcatcatggtcatcatcggcggaattattgccgcgtatggactggaaaccgtactgattccgaatagtgtatctgacggcggtgtaaccgggctcagcattgtcggttcacagctgtttcatttgcctcttgggatcttgattgcggtgatcaatataccgtttgtctggttaggatataagcaaatcgggaaaggttttgcgtttctatcaattatcggtattgtctcacttgccgcgggcacgagttttttccaccacacgccggctatcattgagggagataccctgttaatcaccgttgtcggcgggattattctcggcttgggaatgggattggcattgcgcaacggcggcgccttagatggaattgatatgctggctgtgcttctgtcacggaaattgccgtttggcacgagcgatctcattttatttttaaacatttttgtgtttatttttgtttcttttgtattcgggctgcaaggcgcattgctttccgtcattgcttactacatcgcatccaaggtgatccatgtggttgaggaaggcttaagcggttctaaaacatttcagattatcaccaacgagcctgcattaatggtagagaccattcgtgaagaattgggccggagcgctacgtataaagaagcatacggcggtttttctcatgaaaaattcaaagaaatcacatgtgtcatcaaccgtttggaagaaaccaaactgaaggaaattattaatgacattgataatcaagcctttgtgacggtatatgatgtcgctgaagtaaaaggcagtaatttcagaaaaatccataatcattaagaaggagctgccgttcaccggcagctttttttaaaaaggagaaaacacttgcaaaaaaagaataacggatgtatattattgatatatcaaacattgactagtcaattaattgcgcaaaagaaagtagggatgggttttgacagcatgttgttcagaggaaggcgagattttgtatcagctccaatcactgcacaaagtgatcggcacgaagtttgaagcgtgcaccggaatcagccaatcccgccttgagcttctcgccgtgcttttttacgtcgatgagatcagccaaagcgatcttcagaaaaaggtgaatattgacggcgcagctgtgacaagacacttgaaacagcttgaagccaaagaaatggtcacaagaaggcggaagcctgaggacaaccgaattatacttgtccggcttactgatcaggggcgggagagaattgaggcttccaaaaaggagaaggagcgtttcataaaggaaatgcttgccggtgtcagcgaggaagaacgcagtatgttaaaaaacgtattgtcgcagatgcagaataatatagaaaatatgaaagcataggagtgtattacacatgaaaacagaactgaaaacaaacgattttatggacattatgaaaggccgccgttccattcggaattacgatccggctgtaaaaatcagcaaagaagaaatgactcaaatattggaagaagcaacgacagcgccgtcttcagttaacgcgcagccatggcgtttcctcgtcattgacagccctgaaggaaaagaaaaactcgcgccgcttgccagctttaaccaaacacaggtcagcacatcatctgcggtgatcgcggttttcgcagatatgaacagtgatgactatttagaagaaatttattcaaaagcggtcgagctgggctacatgccgcaggaagtaaaagacagacaaatcgctgcgttgacggcgcattttgaaaaactgccggagcaagtgaaccgtgaaacgattctgatcgacggaggtcttgtttccatgcagctgatgcttacggcacgcgcgcacggctatgatacaaacccgatcggcggctatgataaagaaaagattgccgaggttttcggaatggataaagagcgttatgtaccggtcatgctgttatcaatcggaaaagcggcagacgaaggatatgcttcctaccgtcttcctatcgaaacaatcgcacaatggaaataaggttgaagtgaagctgagaggagagggacagtggacataattgcggctgttttcgtcggaattgtagctttagaacatatatttatcatgatacttgaaatgttttttatcaattcgaaggctgccaagcggtctttcaaattgccgaagcatttagaaggcgatcggaatgtggcggtcatgtttgcaaatcaaggtctgtataatggatttctggctgccggcctcatttggggactgatcctcggagctgatccgattggccatatgattcaaatgtttttcgtcatctgtgtggtcatcgcggccattttcggaggctttacttcaaacaaatcaattatcgtaaaacaaggacttccggctgttttagcgcttatttttcttttattggcgtagcagacggagtgagtgagggcttccggaaaggaagccctctttttttattctgttttgaaaatcatttcttatatacatcactatagattggggatgtcaaatcagctgtcaccccttcttaattgttatttgctgaaagtcttctatctgctaataaagcctaatagatggagtggactccatgtcaatctgtttttttaaaaaaagctgatcggtaaatatggtatgatttacataatcagggagtggggttgcagaggatgaatatgaagagagcgtattacgctattttatacagccagaccgctatcaacttggggttttcactttatacgatggccgtcatcttgtttttgtttacaaaaaccggttcgacggcgatggcctctcttatgacgctcgtcagcattgtatgccgcgtattgggcagcgccgttttgccgctggtcaccggtcggttcacgcttcgttctttgttaatcagttctcaattgatacagatcacactgttagtctgtttgttttttgtcatccaaaccggttcatccgcattcttttttctgctgttttgtctgatcggaggcatttctttttgcaacggatggtttgctccgataaaaagcgcgctgattggggaaatcattcctcctgatcgaagggcgaaagcgaacagtttattatcggcggcggatcagaccgttcagtttgcggggtggtctctgggcggcgtcatcatagcgttcctgggagagagcgatacaatgatcgtcactgtcatgttattggtttcttcggtgttgggcatcattctgtttcttcaagtacgcatgtgtgcgccggcagcagtcagggaacgttccctttttgcagatgcggcaagcggctgggtgtatttatttcagcaaaaacagctcaaggttctcattgtgatggatgtgatcgaatcgtgggcaggcatgatatggatcgggtctgtgtccttaacttatgtgcatgacgtccttcataaaggagaggcttggtgggggtatgtcaacggagtctattatgcagggacgatgatcggcggactgatcatctataagttatccggtaagcttcagcatcatctcattccgcttatgctgacgggagccttggcatatggaatgttcacgtttatttacgggctgatcacaagcgccgttacggccctttttctggtgctgtgtatggggccggcttgtgtattacgagatctcacgcaggaaacattacttcaaaatatcacgaccgaaaagacacgggtcaatatattagcggcgagatcagctttagttcagttcatttttatgttttccattatcggaacggggattatctcggatgtattcggcgtgcggtttatttatattggcgcaggccttctcttattaatttcggcttttatcggattttctcagctgcgaatgaagaaaatggtacagagcggcatgtagtgtagtataattaggaacgtacgttctatatcgagagaggagagggtaatgtgggacatctggcactgcaattgtatgattatcatctttgggcaaatcagcaaatattcacccggcttaaagagcttccggaggatgtgtaccgtaaggagattcaaagtgtctttccgtcgatagccggtgtattgactcatgtgtatctgtcggataaggggtggtttgatgtgttctccggagagcgtctggaggatacgctgaaatcagctgaacagcaaaaagaggacatcttgtctaaagagatagaagagctggaagatctatttttgaaattatcagaccggtatcaactatttttgcagaaggaggaaaatatcagcctcccccttgaaatagagcatccgtcaggtgacatcatgaaaaccgcagcggccgatatgatcctccatgttgtgaaccacggaacgtatcatcgcgggaatataacagccatgctcagacagatggggtatgcttctgtgccgacggattacggtatttatttatatataaacaaaaagtaaacaagacaggcaacgcggctgtcttgtgatatccgtaaaaaagccaaatcatatgagtgatttggctttttcgtttgctatgccatgttttgcagccgttctaaactgtttttccaattcgcttcaagcgctgtaaaagcagcggcggcatcttgctgttctaatgcgtgaatgatatcagagtgttcattatatgatctgtttaaagcgccgttttcactgaaatagcggatttccagtctctgaattttgactttcaggcttactagcaatttgtgaagttcagcgttgtccgcaagcagaatgatgcgatggtgaaatgcattatccgcttccagaacggccattttatcgccgtctttcatcgtttgaagaagattttcattcagctgtttcaattcttgaatcacggcatcgtccatacgcgggagggcttgctgcaatgcgagtttctcaagcgtccagacgatggaatacaagttttccgcttcttttaactcaatcggagcgacaagtgtccatctgttcgcttttgttatcaccaagccgtcatcttccagccgcaataaggcttcccgtatcggggtgcggctgattcccaatgtttccgacaaatccttgtcctttaactttgtttccggtttgagcttgcccgttatgatccagtttctgagtgtgcgatacacttcgtcccgcatgatggttcttttcagcacaggttctttgttttgattatccaatggaacacctcatgaatcgtagtatacatatttgcattttaccacagtccgggcgccggttagaaatgaagagggacgtctaagaatgaatcgaaccgagatgcttcatctcaatatgctgaaagtcagcggagccgccttcagaaaagagcgtgattccctgatcttcgtgttttgggaacacttcatttgtcaaaacggtttttccgtcgtctgcaaatacttcaatacttgttttatccacgagaattttcagatgaacgcgccctttgtttccgtcaaatggggctttgctttcggtgtatgcaccggttttatcaggctggtctgtaaacgatctgttcacataggcacaaccgtcttctgctgaaataccgacatcaatatgccggctttggtctgctgattctctgagtctgacgcctgcatttttgatatctgaccaagcgatatccatatcaagctgatatgtatcacctttgatcggcagtgtctctgaaccgttcacctgtttgtgttctatgctgtcagttgaagaagttaattggttcaatgcttcaaccggctctgacacaaggctgtatgtgccgccgtcctgctgctgaagacggatttcacggacgatagaatccgtgccgttaaagccgttttttagtgtcggtgtttcattcggataatcccaattgttcatccatgccagcgcatagcgttttgtcagcggatcttcgctattaccgtcttcaaatgtgacgccgccgtaccagtcaaagccgtaatcaagccattgcggttcttcttgatcggcggtaaattccttcccgtcaaagtttccggtccaatacgcgtacgtattcggtttgcctgcgggtttgccgtttgcgcttgcgcccagaacccacttggctgtgccgtcatctgcacgcatcatataaaggtcggggcattcgatgaggccgatctgctgagtgataaaaccgcccgtgtatttccaattttttaaatcgggtgattcataaaaaccgattttttctccttcggccatggccatcacccatttgtcatcctgttcatcccagatcactttcgggtcccggaaatccttagttcccgggtttttcataacgggctgatcactataggaagtaaacgtttttcctttatccgtgctgtaccataaatattgttcctgggcttttgttttggctgtcggctgcgttgtgacggcgaccagcgcgtttttgccgaagcccgcggtgttgtgtttatcaatgacgacagaaccggaccagatatcgccgttttcgttggtgtatttcggaatagccgtgccttcgtccgtccagtgcaccaagtcctttgatacggcgtgccgccattctgtgccgttgccgttcgggtaatcccgattataaagatagtagtaatgatatttcccctcgaaaaaaataggcttttgagggtcgtttttccatttgtccggagtcgtaaaatgatacgccgcccggtaatccttcttatgctccgtgttgtttgtgtcagaggaattgtggtttttgttcggcagtaagccgacaaacaggaacgcacccaaaaagatcaatattacaacgggccattttcgtgccatgattgaattcaccatcttattgagaaataaaagaaaatgccaatgaagtatcggcattttctttttgttgttattagttgttaaccgtaagctgtccttgttcaaggatgctgtttttaacaacggatgttttcttgcctttgatgttcattaagaagcttggcgcaaatgtcgcctttttatcctcaaagaagcctctgtttgtcatgtagcttgtgatcacgacattgttgcctttggcttgcggcactgcgaagtgagagtaagtgaacgttacgtcgttaggatcaagacccatttgcaggacaagaccagttttgttcagcggcttgtaaggacctgttaaagagtttgatacataaccaagcatgtaaatatcgtttgagttaataccgtcgatcgtcatttttgaaccgcgtgaatcagtgaacaggtaccatttgccgttcattttgaaaacattcgcgcgctcgatttcatcagttaccgtgtttgaagtgatcagcggcttcatgacttttttcaatgtgtaatcatcgtttaactctaccataccgagggcgccgttcgctaattcagcatcgcgttttttagcgctttgctgaagcttctgactttctttacggaagaagtttgtgctgccgccgtagtacgctttgttaaataaagattcttcgccttggtatccgttttctgttcccgtgttggcttcgaatacaaggtatttatgtcctttgtcttcaacgtagtgagggtctctcagcgtatggttgtcgccggatgtatagttcccttcatcgataaactgctgaacgttttgatatgtttttccgtcgccgtcaaaaatcgttttatgatcttcaactccgttgatcttgagcgtgtcatcagattttgacacatttacctgcgccgttgtcaggctttgtttgccgtaatgtttaccggaaaagtcagtgtagaataaacggatttttccgtcagatgtaaaggttgcagaaccggaccattcttgtgtctgttctttcaggatttcatcgttggcgtcgaacttatcgctgtctttaaagacacggcccgcgtttttccagctgtcgatcgagttgtcgccgactttttgataaaacatgtagatggatgtgtcatcagcgtctttcgggcttccggcaagagcaaacacgacgtgatagccgttgtattcagctactgttccgtcagcgttttggagcggccagctgtcccacacatccagtcctttcgcggactcgatatttttaattgttgatgggtcgaattgaggcacttggtatttttcactttgctgctgtttagggatctgcagcatatcatggcgtgtgatatgagagacgccgtacgtttctttgtaaggtttttgggtattttctttcgcgaaggcttgagtcgctcccctgccagaagtgcagtcgtaaaagttagaactgtggctcgttttgcaaattttttgatgttcatgttcatgtctccttttgtatgtacctttttttgcgatctgccgattcgatcctcctgcattcatggatgacaggtttgttacagaaaaaaagacctaaaatatgtatggggtgacgccaaagaatacactttgcccttaacacattttaggtcttgcctgctttatcagtaacaatcctgcatgatttacttgtcgacatcattctattagactctgattctattgacaactggtctattttcctcttttggatgatagtaaaatgaaaaaaggccttttaatatatgggtaattgagcctaaggggtgctctggccctaggaaaaaacctctctaaaaaagagaggttattttttcttgatagataataaagcgatggtggttaaaatcagcaaagtacccagccattctgatattccgaagggaacatgcagccagataacagttaaaaaagctgccgacagcggctctgcacaggcgagcaggctggtttcagaggcactcagatatttcaggctttccaagtagcaataaaaagcgatgagcgttccgaaaatgatgataaacacaatcgcggcatatgcaggaaaggaccactcgccttcaaatgtccagggcgggcggatcaagctgagggcggctccgccgatcagcatgccccatcctacaacaatggcggatccccatttcttcagcagacgatgcggctgaagggtgtaaaacgccagtgcaaacgccgaactgattccccaaaagacggccagaccggatatggacaggcttccgacattcccgtgcgtgaccaaaatgaatgtgccggcaaccgccaataagacggcgagcagctcttttcctgaaggaattctctttgcgcgaatcgctaaaaagcatgtaatgatcgccggtcctaaatactgaagaacggtagctgttgccgcgttgccatgctcaattgccgcgaagtaggtgtattgaacacctaacattccgaaaatcccgaataaaagaaggggaattctgtcccgtctgtctttccaaacagcccatatccgtcctttttctttgcggtacgcgattccgagcagaagcgcccctgacaccagaaggcgcaccgaagtcagccattctgtattaaaatggcggtgctggaacagatactgggcaaccgttcccgagacccccataagatagctcctgtaagcacaagccaaatgcctgttgttcgtgaataagaaagagcagcgtgtttttccaggatagacacccccgattctgatgttgcgacagcaacttacaataattagaaaaatgaacgccttacatgtgatatattatatattgtatattaataggcgtcaaaataattttagagtaagcgcttacgaaacggccgtctgatgaacgagctgtaaaaaaaacaccccggctggttgccggggtgttttggttattctgcaatcgcgtctgttaaaacaggaacgacttgtttctttctggatacgacgccttttaaaagggccgtgttgttttctaacgtcacgttgaatgctttttccacttttgacgcttgatcaccgatggcaagcgcaagggaatcattttccagaatatccgtaatcacgagaaggaacaggtcaaggttcttctcggcaattacttttgaaagagccgcttctaattccggctgccgctttttgacatcttcaatatcaactgtgttgacttgggcgatttcgacttttttgctgccgagcgtgaactctttcgcatcaagagaaatcagttcttccacagtttttttgcttaagtcggcgcccgctttcagcatgtttaagccgtactcttccgcatctacgccggcaatttcagcaagctcttttgccgctgcgatatcttgctccgtgcaagtcggagatttaaataacagagagtcggaaatgattgctgacagcatgaggcccgcaatttctttctcgattttcacgttattttctttgtacattttgtttaagatcgtagccgtacagccgaccggctcagcacggtagtaaagaggttccgctgtttcgaagttggcgatacggtggtggtcgatcacttcaagaacctgaacgtcttcgatatctttgatgctttgctggcgttcattgtggtcaacaaggatgacgccgtttacttcgtttgcggctgtttccaccaaacgcgggctttcctgcttgaaataatcaagcgcgtattgtgtttcgccgttgacttgtccaaggcggacgggctcagcattgaagccgagtttattttttagatcagcgtaggcaatggcagagcaaatggtatctgtgtctgggttttgatgtccgaaaataagaattttttccataataactccttgtccttttttgtagtgtaaacaatctttttatagtttaacacgtcttgcggagggtgtaatcttcaaaaccttaaaaattgatgtgaaaaagaagcatttttgttgagcggtgaggaggattgcgagtaaaatactgggtaagtcagatgctaatcagcatatagtatcaaaaaaggtactatggaggatgaaaaatgaacatatatccgaataaagaaggttgtccggttgaactgacgctttccgttatcggcggaaagtggaagggtattttgttttatcatatgatcggcggaaaaaagcggtttaatgagtttcggcgcatttgccccagcattacgcagcgtatgctgacgcttcagcttcgcgagcttgaggcggacggcatcgtgcatcgcgaggtatatcagcaggtgcctccaaaggtggagtattctcttaccgaattcggcaggtcgctggaaccgatcgttttgcaaatgaagaaatggggagatgccaaccgggagtttctcgagacataccgggaaaaaacgtcgcctcaagatcagtccgctcaaaaataagaagcagcaaaggattaaattccttgctgcttttttttatttcatcgcgatggcttttctggcgttgcgcacatcattcttcagcaattcgctcaggttgtaagccggatattgaccgcgttcttccatatactcaaagaccatttgatgccacttgatggccgcgtttaagtgcttgacgaaaacgtgtctcaattggggtgtggccgtctctgtaatggctccggcgtaattgcgcacagacgttttggccatgctcagcagaccgccgctgtaaaacgcggaatcagcgcgctcttctgtttcatcctcacgaaaagcgggagcttcagggaagaaaggaagcagttcacgcagattttgttccagcgaatggatggaaaatcggtaaagctgttttaatctggcatcgcttacgtcccgctctgttctttttaatttcacaagtccgtttgcctggaaagccactaactcatgcagttctaacgtttcatgccatgctaatgttctccgctcggtcatagtgtaagaatctcctttatccttcattttcactttcagcatatgccccggtcccgatgttgttcctgatgttttgaagtttccagaaagggaaactcaatgtaaaggaaatacgaaatagaggtgaaactatatgtgggacatgataaagaacttcttccttttcagcagcggggttttacaggcgaccactctcttacttatcgttatcgtcttgttatatgtacgaaaaaccaaaaagaaaaacagagaaacttctggttttatggatgatcaggatcactgatacaacgggcattctttcacggggatgtccgtttgtctgttttcatgtttcacatggaacattgcggctgtccgcgctcattttacttgcgatttcgacttatgttaaaatatatacgtgtattttggagagtttatggaaaattcaggtcttgaaagagacattgcggcgtcaaaagagcagtcgtctaagctgctcttttctattcgtatgttcgaatgatacaaggtttgaggtgagtaagtgaaaaatacaagggctctaatagaaggcgccattttgatcagtatttttgcaatcatttcccttttggtcgtgtacctccctttactgggggcaattcttctctttgctttgccgctgccgatcattctttacaccattcggcacggtctgaagcccggggtatggatggggcttgccagccttcctgtcagctttattgtaggttcgtttaccgggcttacaggcgcttttacggcggcctgtacgggaatcgccatgggatattattttaaaaagaaacagcccggctatgcggttgctgccggcgctatggcgtatgtgctgtgcggcgtcgttttttttgtggtcagcatcgtgtttcttaatatgaatgtgatcgataccaccatgtcccagcttcgggagtcgatgtctttagcagaaaccatgtcaaagcagctcggttacggagatcagttcgggaagcagatcaagctgatggaaagtcagctgagcacggttcaatatctttttccgacagtgctcgtattgaccggcatcgttttttctttcctcagttatgctatggcaaggccgcttttacggcgattttcccctgatcttccgaagatgaagccttttagagagctcaaactcccgcaaagcgttgtcattctgtattttattgtgacgatattagggtttctgcctttagaaaaagggcatatgctgtattcggtttcattgaatgggggatttattctcagcttgctgatttgtattcaagggttagcgtttatttttttctattgccgcgaaatggagatgccgaaagccgttcctgttttagcaattgtgctgggtgtgctttttccgctcatcttgtccgtgtatctcctcttaggcatcattgacataggctttaacataagaaataaggtgacgcgaaattgagtgtgacttacaggtggggagttgatagaaatgcctagtttttatgaaaaaccgttgtttcggtatcccatctatgcattgattgcattgtcaatcatcataatcctcatcagcatttactttaactggctgataggagccatcggcgttgtgctgctcgccgtgatcctgtttttcattaagcgtgcggattctctgatcagaaaagaaattgacgattatatctccacgttatcgtatagattgaaaaaagtaggcgaagaggcattaatggaaatgcctatcgggattatgctgtttaatgatcaatattacattgagtgggcgaatccgtttttgtcttcctgttttaatgaaagtacgctcgtcgggcgctcgctgtatgacacatgcgaggccgtcgtgccgctgatcaagcaggaggtcgattcggaaacgatcaccttgaatgagcggaagtttaaagtagtgattaaaagagatgagcggctgctctatttctttgatgtgacagaacagattcagattgaaaagcagtatgaaaatgagagaaccgtgctggcatatatctttttagataactatgatgacgtcacacaggggctggatgaccaaacgagaagcacgatgaacagccaggtcacctcattattaaatgcgtgggcgcaggagtacggcattttcctgaaacggacgtcctcggagcggtttatcgcggtgttaaatgaacacattttaacggagcttgaaaacgcgaaattttcgattttggatgaaatccgtgaaaaaacatccgttcacactgtatctttgaccctcagcatcgggatcggcgcatcggtttcttccttgaaggagcttggagatctggcgcagtccagcctcgatttggctctcggccgcggaggcgaccaagtggccatcaaaatgccgaacggcaaggtgaaattttacggcggcaaaacaaatccgatggagaaacgcacaagggtgcgcgcccgggtgatttctcacgcgctcaaggagattgtctcagaaagcagcaatgtcattatcatggggcacaaatttcctgatatggacgcagtcggagccgcaatcggaatattgaaggtggcgcaggccaacggcaaagaaggctacatcgtcattgatccgaaccagatcggatcaagcgttcagcgcctgattgaagaaattaaaaaatatgaagagctgtggtcgcggttcatcacaccggaagaggcgatggagatttcaaatgacgacacgctgcttgtcgtcgttgatacacataaaccgtcccttgtgatggaagagcgtctcatgaacaaaatcgagcacatcgttgtgattgaccaccaccgcagaggcgaggaatttattaaagacccgctgctcgtttatatggagccatacgcttcatccaccgcagaactcgtgacggagctgcttgaataccagccgaagcggctcaaaatcaatatgattgaagcgacggccctgttagctggtataatagtggatacgaagagtttttcccttcgcacgggctcgcggacgttcgacgccgcttcttatttgagagcgaaaggcgcagatacggttctggtgcagaaagttctcaaagaatccgtcggttcttatatcaagcgggcgaaactgatccagcatacagctctttataaagaacatatcgcgattgcttctcttcctgagaacgaagaggagtactttgaccaggtgctgattgcgcaggcggctgattccctcttatcgatgagtgaagtggaagcttcatttgcggtagccagacgggatgagcatacggtgtgcatcagtgcgagatcgctgggcgaggtcaatgtgcagattattatggaggcgctggatggcggagggcatttaaccaatgcggcaacccagttatcgggcatttctgtctcagaagcgctcgtccggctgaaggaagccattgatgaatattttgagggaggcgttcagagatgaaggttattttcttacaagatgtaaaaggtaaaggaaaaaaaggcgaaatgaaaaacgtagcagacggttatgcacataactttctcattaaaaaaggcctcgctgtcgaagcaaatgcgacaaacatcagcgcattgaaaggacagaaagaaaaagagaaaaaagaagcgattgccgagcttgaaagagcgaaagatttgaaagaaacgcttgaacagctgactgttgagctgagtgccaaatccggtgaaggcggccgccttttcgggtctgtcacaagcaagcagattgcagaagcgctgcaaaaaacgcataagattaaagtggataaacggaaactggagctccaagacggtatccgcacactgggatatacaaacgttcctgtaaagctgcaccctgaagttcaggctgtgctgaaggttcacgtaaaagaagaagcgtaatacacaatgaaaaacccgccgatccggcgggtttttttcatgtcagcagacggcgcagcgcaagaaaatgatgagattgtttcatttccgatcgttaccagattgcatattatattacatcataacgaaggatgtgtcggtatgaaacgatttttttctgaaacatattttaataatccggagaataaaaaggcgctggagcattatccgctgatcggagacggaaaagacggggaagtctaccgcttaacacacaacaaatgcataaaatacttctttgaaaaagggacatgcaagaaggaattggcggctttaaagaccggacaaggttccccggtgattccaagactgtatgaatacggagatcgttatattgtgatggaatacgtccaaggcacctctcttgcccgccatatcagaaaagaaaaatccctgtccgtcaaaatgactgctgatattttaaatatgctggatgaattaaaaagaatcggttttaccagatgggatgccgaaatcaggcacattctgatcaatgaacacggaaatcttaaagtcatcgaccataaaagagctttttccgctattacccggtttcccgtaaaactattaaaaggactggacaaatacggcttggcggatgagtttttgaatactataaaaaaattaaatccgtcacgttacctggaatggcagccgcacatgtaagtttctgaaaatccgcacatgtaagtttcctttttttagggtcgtcatatgatatttgtaacatttgtttggtggagtgtggaaaaaatggcagaatacattatggttatcggcgctcatcccgatgatgaactattgggagcagcgggcaccataaaacggctgatcaatgaaggatataaagtgatttccattattacggcattaggaagaaaagaagaagctcatcatattaaacaattaggcgaacgcgcgaatcaagagcttggaattgagaaagtcatctttttggagcatacgaatttagagctggaatgtatccctcttcataagcttgtcaaagaattagagcagctcattcgcgtctatcagcctgataaaatctttacacatcattacggcgatatcaatatggaccaccagagaacattccaagcagttttaacagccgccagaccgcttccgaatcaaaaacctatcgaactgcttacgttcgaaacgctatcttcaagcgagtgggagaggaatacggctgataaactcttcaaacctaattacttcgttaacatcacagacacaatggatgctaaactcgcggcgcttcaccactatgacgtagaaatgagggattaccctcatccccgttcatatgaaggcgttaaacatttaggaaaagtcagagggatgacggcgggtgtggaatacgccgaagcttttgaagtcgtgcggaggatctggaaatgatcaagacattttccgtcccgtatccgtatatggtccagacgcttgaccgctactacggggtcaaaacgcgccctcaaaaaaaggcggcagtaaagacacagttgaaacatgaacatcatattccgcggttatacaggaaaaaaaagaagttatccattttgattgccacgttttgggactacccgcacacgggcggtttatcaaactatattaaaacgcttagtgaaggcctgaagaagaggggtcataaggtggatgtcatctcccctaatctgtttccgtccgcacaggtaaaagaactgcgggcggctgttgttccgaagttaaaagatttctttaaggacagatatggggattataacaatcatattttgaaaaataatcggctgatgtttatatacgagcaaatgcttcaaaagattcatttggaaagatatgatgtgtttcatgctcaagatttatttacagccaatatattaggcagattcaatcaaatctataagaaacctttatttttcacaccgcatggcatgtttactttcaacagacttaaatttcacatctttaaaaaaggatcgatagaagagttttattataaaaaactagagatgaaagccattgaatacgcagatcgcctgattattatcagcgatacgttccgcagcccgctcatgaagctcggagccgaacaggaagacatgacaacggtgatcacaggaatcgattacgatgcaaaaacaggcgggaaaagaaaaatcccgctgccgaaaaataagatcatcatctcgtgtattgcaagattaggcccgagaaaaggacataatcatttgcttgacgcactttcacgaattccgtctgatgtacttgagcatgttgaagtgctgatcgcgggcgacggagagatgaggagcgccttagaggaacaggctcgaaaactgaatctatctatggtttcctttttaggaaaaagagatgatgttcccgctattttgaatatgacggacatattcgtactgccgaccgttaatgacagtctgcctatttcgattattgaagcgatgttcagcggctcggctatcatcgcgaccgattgcgggggtattccggatctgatccgccataacaaaacggggcttattgtcgagccgggaaatgcaaaggttcttgcccgggctttagcgttttttatcactaacaaatctgcgcggaagatagctgcttcaaacgcaaaggcctacgcggagaaatatttgagcagtgagacgatgataaaaaatatcgaatcgatttatcaaaataccaacagctcggagggagatcatgaaacatgaacatgcagccgttgtactagatttcagtgcaaacgggattgggatcattcgcagcctggcccgaagaggaatcgatgtttacgcatttgacacggagggaccttatcgtatcggaaaatcaagattggcagattgcgggatatgtcccagccctttaacacaagaggaagaactgctgacattcctgactgatttcgggaagcgattccaagcaaagccggttctgtatgcaggttctgatgattatgcgggatttatatctaaattccgcgagacattagccggtttttttttatttttgctcccgagccgctctctgttagaaacggtcttagataaaagcaaagcatatgaattagcggtcaagcataacatcccctgcccgaaaaccttttttccgaacaaccgggatgagctggaagaggccatcgccaatattgacttcccgtgtattttaaaaccggtggccggccatgaatacagaaaaaaagtaaacaaaaaagcaattgtaatgaaggatgccgcacaattgcgcaaggagttcagctcctacagagaaaatggagaactgctcgtgcaggagatcatccccggagacaaccagtgtttttataaagtcgccactttttatgatgaccaaatgaaattaatgggcttattctctctgcaaaagaaccatcaattccctgctgattttggcgcgggggcccacgtcgtcagcaaacggcttcctgatttaatcgagaagaccctgccgttttttgaagcgattcagctgaagggagtaggcatggcagaatttaaaaaggacccccgggacaatgtttataagtttatcgaaattaatccgcgcttttggctcagccatagcctgacagaaccggcaggcattcatttcgtttacatgtactatctgtatttgaccggacaacatgtgaagccccagctcgaacaaaaagacggaatcaactggatttatgaggtgcgttacttcttaacgtttttgaagaaacgaaaaagaggagaaatgacgttccgggatttttggaaaggatttaaaggaaaaaaagagtacgctctgtttgcttggaatgacccgatgccatttatcagaaacacttggtctcatctcaaaaacagctggaaacggaagcggaaggaagatcggcatgtatgaaaaggatcttttgtatgacgcatttcaaaaactgagaattgacgaaaaactgtcgtattcgttcggtgaaagggccgcggtgaatccggatgacatcacatgcctgaaatcaacagacagaagcgccatttataaactgtttgtaaagaaaaaatccggaattgttccgctgatattgaaggtgtataaatcttcacgtgaaaaaaacaaggtcgagattaatatatacgggaaagcccgttctgttttaggggatttgctgccggacatctatcttatagaggaaagtgaccatgaaacgtggatatttatggagtttgtcagccagatcagaggacagcttacatttcatccgaagcatttcaagtatattattccgtctgtcgcagaactgcacagccgcacctttgaaaacaaggctgtttctgacggtaaatggcggtcgtggctgccgctatacgaatcggaaaccatgagaaaagggcgtaaaaagcagatcaaaaagacagcggaattattggatagagctcttaaagatgagcgcacaaaggatatcgtgaagcctcattatcggcaaatcacaaacttgctggagcaggaggagccgggttttttccctgaattggtccaaaacggctcagccatcacacacggtgatcttcatatgcagaatatctgcacccacgatgcgtccggacatgaaccgtgggatattcaattcatcgattgggaatccgcaaagtacgcgccggtttggtttgatatgacggtgctggtcgaaattctgctcggcttcagaaaagactggagccggcacgcagaagatattcggacgtattgcgtaaaagtgtatacgaaagaaatgaaaaagcggggcattcattttcagacccctcctatgacgctttataaaatggcttatttgcagagaacacttgagaaagggcttcatacccaattgcggagaatcttcgacaatcggggaggagaactgctgccgtatcatgttgacaaagtgtcaaaatggggacgggaattaggattataagtttaagagagggggagcggatttgaaaggagagatcggcaagccgaacggtctggtgcctctaaccttattgcgcgtcatggatcaattttacgggatcgaacatcaaagtgagccggagatgctgtattcgttctgtgcggaaggaaaaagctcccccaaacgaaaaaagccattgcgtattctgtacgcaacctttctccgttacccgaatgtcggaggactggcgagttatatcacgtcaattaagacgggttttgagcgcatcggtcaccaggcggatgtcatctcgccgctccaaatgccgccaactttttttcaggaagatatcccgcgggccgctgacgagatcagagcgtttcttgttggcagatacggggccgcaaacgaaaagtttgtgaagaatctcagctatttacatgtctttcaaagatttttgaaggagaaggacttagaacaatatgacctgtttcacgcgcaggatttatttgcggcatttttgctgggataccttaatcaaacgtatcggcatccgcttttttttacgccgcacggacatttcacgaaaagccggatgaagtttcataaaatccaaaagggttcaatagaagaggcatatttcagtgaaatagaaaggcagggtattcgggcttcggataaaatcattacaatcagcgactcctttcacgagcccttgctggagtacggagcgaaggaggctcagctgacgactgttcataccggcattgacatccgggttgcacccgagccaaaacgtgctgaaaaggtcgtgattgcgtgcgtttcccgtctgaccgagcgaaaaggacatgatgtgctgctggacgctctcgcccgcatccggcaccatttatccggagtggatatatggatcatcggggacggaaacatgagagggtttctggaagagaagagacggaaactgggcctctcaaacgtgtttttcctcggaaaacgacatgatgtgccggcgcttttggctgaatcatctatatttgtcctgccgacattgaatgataatttccccatagcgatcatcgaagcgatgttctcaggtcaagccattgtcgcaactgactgcggaggaatccctgagatgatccggcacgaggacacagggcttatctgtcagcccggcaacagccgcgaacttgctgatgccctcgtaaagctgattacggatcagtctctcagggaacggcttggaaaagaagcgcgctcctatgccggccggcatctgcgtcaggaactgatggtttcaaaaatagaaaggatttatcaatcatttttctgaatgataccggcgccgcatggcaggtgcttcaagagcaaaataaagaggccggtgtttaactatccagcctctttccgagctgttttttcatctcatacagagtctgctgactttgtccgcccgggccgcctgtcattcctcatcgggctgagcctgtttttccggtgctgtatcggtcagctgagatttttgtgccgttctttttaatccatgagacaagctttgtgttgcctgaattgtttccggataataagaaatagttcacttttccttcgtcaacaagttttttcagctgtgagacggttttaccgaaattttcttcatggaaaaaagaggcggaaagccatcgcttccgcctcccgcacatatatatgagagagcagcctttatttgtgatcgttctctttttggatttcagctaatttggcaagcagaatgtgctgaggcatgtgcatgattctctcaagcggcatattcagtgattctgcgagcttttgcgccgtttcggcggaaatttgcagcggtttcatgtgatcactccttccgtttctttattgtactaaaatcagaaatctatcgtaagaggatatgacaaaggaatggaggtttgaaaagcggggctttataacagaatgggggaggttttttatgcaatcgccattgatgttattacagctgaagctggctgattatcagaaaaaagccgcagaactgcggacaattgacgaatttatcatactgaaacagacattgcaggacatgatgaaagtattcgccgcctttgaagaatgggagctgtatcaaaaaacggccgatctcatggcgcagacggtgctgcacatccgtttcatcgaataagaaaagccctcgcacgggcgaaggcttttcttaaaaggaacgttcctcttcaatgtttttatgctgatcataaatgacaagcttagccgggctgttctctttcgccatctgctccgctttttcaatcgccgcgtcctttgatgtacaaagagccgtcggcgccacattttccaccttcacaaaccatccgtccgcatcaacactgggtgttactgcatatgttttcatccttcttacctcccggtttcgatttatttatttgtttcccggcattcggaacggtaaaacacataaccctctcctgacaaatacagggaaagtgatatttttctattctttttcatgagaaatggtaaaatgaaatttggatattttttaaggaaaggacggtgcttagcatgacagaccttctgaatgatcggctgccgccgcaaaacatagaagctgagcaggccgtgttaggtgctgtttttttacagccgtctgcgttgacactggcttctgaagtgttgattccggatgatttctacagaatgtcacatcaaaaaatttacaatgccatgctcgtgctcggagaccgcggtgaaccggttgatttggtcacggtaacgtcagagcttgcgaataccgatttgttagaagaggtgggaggcgtctcttacctgacggacatcgcgaattccgttccgacagcggctaatatagaatattacgcgaaaatcgttgaggaaaaatccattctccgccgtttaatcagaacggcgacctcgatcgctcaagacgggtatacgcgcgaggatgaagttgaagatttattaagcgatgcggaaaaaacgattatggaggtcgcgcagcgaaaaaattcgggcgccttccaaaatattaaagacgtgcttgttcaaacatatgacaacattgagcagcttcacaaccggaaaggcgatattaccgggattccgaccggctttatcgagcttgaccggatgacggcgggttttcagcggaatgatttgatcattgtcgcagcccgtccgtctgtggggaaaacggcgtttgccttaaatattgcgcaaaacgtggccaccaaaacggatgagagcgtggcgatattcagtcttgagatgggtgccgagcagcttgtcatgcgtatgctctgcgccgaagggaatattaacgcccaaaatctcagaacgggtaatctgacggaagaagattggggcaagctgacgatggcgatgggaagcctgtcaaacagcggtatctttatagatgacacccccggcatccgcgtcagcgaaatccgttcaaaatgccgccggctgaagcaggagaacggattgggcatgattttaattgactacctgcagctcattcagggaagcggccgttcgagcgacaaccgtcagcaagaggtatcggaaatttcacgggcgctaaaagcgctggcgcgggagctcgaagtcccggtcatcgccctgtctcagctctcccggggtgttgagcagcggcaggataaacgtccgatgatgtcagatatccgtgagtcgggaagtattgagcaggatgccgacatcgtcgccttcctgtatcgtgatgattactatgataaagaatccgaaaacaaaaacatcatcgaaatcattatcgccaaacagcgtaacggcccggtgggcaccgtctcactggcttttgtgaaagaatacaataagttcgtaaatctggaaaggcgctttgatgacggcggtgttccggcaggtgcgtaaagcctcaagcaatgtcttgaggctttttttcatccgaaagaatgagagaatgccgtctgttcggcagtcgataaaaagaaagcgcttttatataatggcattaagggagggatgatgatgacaattgaatttccgcaatttcaagcggcgcaaatccggattgcccggccgaccggacagctcaaagaaatcatcaggttttatgaagaaggcctcggattgaagagggtcggcagtttttccggacatgagggctacagcggcgtcatgttcggcctgccgcatacgcaatatcacttagaattcaccgaagaaaccggctcgtctcagccggcgcccgttccgcacggcgacagcctgcttgtcttttacatccctgatcagcaggaggtcattcgcatcagcacgaaattaaagcagatgggatatgaggagaaagaacccgaaaacccgtactgggaagaaaaaggcgtgaccatcgaagatcctgacggctggcggatcgtcctgatgaatacaagcggaatataaatgactgtctgaagaacccgggatatgggttctttttcgtgttaaagtatgaaagtttcgggagtaatagatagcaaatgaaagagaaaacgcttttaatcaggtttaaggcgaacaaatatagaataataagattttaatgttcggatttacgattgactttctgtttcggcactgatacacttaatttgtttgaatgagatatcgttttgaaaggttaacggaggtgcacggatatatgtcttcagtagtcgtagtaggtacgcagtggggcgatgaaggaaaaggtaaaattacagatttcctatcagaaaatgcagaagtgatcgcacgttatcaaggcggaaacaatgcaggacataccatcaagtttgatggcgtcacgtacaagcttcatttaatcccatcaggaattttttataaagaaaaagcgtgtgtcatcgggaacggaatggttgttgatccgaaagcgctcgtaacggagcttgcgtatcttcatgaacgcaatgtgagcacggataacttgagaatcagcaacagagcccacgtcattcttccataccatctgaaactggatgaagtagaggaagaacgcaaaggggccaacaagatcggcacaacgaaaaaaggcatcggacctgcttatatggacaaagcggcgcggatcggcatccggatcgcagacctgctagatcgtgacgtgtttgcagaaaagcttgaacggaaccttgaagagaaaaaccgtctgctggaaaaaatgtatgaaacggaaggcttcaaaattgaagatattctggatgagtattatgaatacggccagcagattaaaaagtatgtatgcgatacatccgtcgttctgaatgacgcgctggatgaaggccgccgcgttttatttgaaggcgctcaaggggttatgcttgatattgaccaagggacatacccgtttgtcacttcatccaacccggtcgccggaggggtgacgatcggttcaggcgtaggtccgacaaaaatccagcacgtcgtcggtgtatctaaagcgtacacaacccgtgtcggtgacggtcctttcccgactgagctgaaagatgaaatcggggatcaaatccgtgaagtcggacgcgaatacggcacaacaacaggccgtccgcgccgtgtcggctggtttgacagcgttgttgtccgccatgcccgccgtgtcagcggaatcacagatctttctctgaactcaatcgatgtgctgactggcattgaaacattgaaaatctgtgtcgcttaccgctacaaaggtgaagtgattgaagaattcccggcaagtctgaaagctctcgcagagtgtgaaccggtatatgaagaaatgcctggctggacggaagatatcacaggcgcaaaaacattaagcgatcttcctgaaaatgcgcgccattatctggaacgcgtatctcagctgacaggtattccgctttctattttctctgtcggtcctgaccgttcacaaacgaacgtcatccgcagtgtataccgcgctaactaagaatttgcagcaaacaagcctccggtcacggaggcttgtttttttatgtaggaaaaaaataatagattttttttcaaaaaagtagttgccactttcgaatgttctatgatattataaatctcgttgttacggaacagcttcaatagagtactgcaagaaagcttttgtctcaatgctctatgatacataatccgacacatcaagagccattagctcagttggtagagcatctgacttttaatcagagggtcgaaggttcgagtccttcatggctcaccactttttatggcccgttggtcaagcggttaagacaccgccctttcacggcggtaacacgggttcgaatcccgtacgggtcattgatttactttagcgttattgctaactccttatttgtcctcggagggccgccacgatacggttctccggacaaattactgtaaggtccggtagttcagttggttagaatgcctgcctgtcacgcaggaggtcgcgggttcgagtcccgtccggaccgccattttactttactttatagtatagaaaagaaacatctggctcggtagctcagttggtagagcaacggactgaaaatccgtgtgtcggcggttcgattccgtcccgagccacttacccaaacgcatctgcaatagtaggtgcgttttttcttttgttataaaaaagggagagccggcttttcagccggcccagaagaagacgtcaaacactagacggcgttttttttcttaaggtttcaaaaaaatattattttttaaaagaaaataaaaaacatgacaaaaggatggcagttcaatacgtttttgcgctgttctctttaatttttttatcttttgacctgaaaccgttataatagacggggaacgtttttcacgatacgaattgtgatcatcatgaaacatcaatagatgaaatgaagtcattctggcaggaggaaaatcaagatgatggataagaaaatccttgtagtcgatgatgaaaaaccgattgcagatatattagagtttaatttaagaaaagaaggctatgacgtgcattgtgcgtacgatggaaacgaagccgtggaaatggtggaggagcttcagcctgatttaattcttttagatattatgcttccgaataaagacggagttgaagtgtgccgggaagtccggaaaaaatatgatatgccgattattatgctgacggcaaaagactcggagattgacaaggtcatcgggcttgaaatcggagcggatgactatgtcacgaagcctttcagcacgcgtgagcttctggcccgcgtcaaagcgaacctgcgccgccagcttacggttgcgccggctgaggaagaatcagcttctaatgacattcatatcggttctctcgtcattttccctgacgcttatgtcgtatcaaaaagagaagaaacgatcgagctgactcatcgtgagtttgaattgcttcattacttagccaaacatatcggacaggtcatgacccgtgagcatctgttgcagactgtgtggggctatgactatttcggtgacgtgagaacggtggatgtaacagtgcgccgtctccgtgagaaaatcgaggataatccgagccatccgaactggatcgtcacaagacggggtgtcggttattacttgagaaatcctgaacaggactaaccggcgatgaataaggttggtttttttcggtcgattcagtttaagatcacgctgatctatgtgcttctcattatcatcgccatgcagattatcggcgtgtactttgtgaaacaggtggagaattctcttctcaagtcctatgaattatcgttaaatcagcggattgacaatctatcctattatattgagcaggaatataaaggagataatgacagcaccgtcattaaagatgacgtcaaacggattttgaatgattttacgaaaaacaatgaaatacgggagattacatttgttgataaaagctatgaggtcgtcggttcttcgaggccttatggcgaggaaatagcggggaaacagacgactgacccgatttttaaacggattttctcaacaaaacaggcctattcaaaaaaatattatgatcctaaaagcaaaaacagagtgctgatttcagcaaaacctgtcgtcacagagaatcaggaagttgtcggcgcgatttatgtcgtggccagtatggaagatacctttaaccagatgaaaaccgtcaactcgattcttgcttcaggaacaggcttagcccttgttctgacggctcttctcggtatatttctcgcccgcaccatcacccatccgctatcggatatgcgtaagcaggcgatggaactggcaaaagggaatttctccagaaaggtgcggaaatacgggcatgatgaaatcggtcagctcgcaacgacattcaaccatctgacgagagagcttgaagatgcccaagccatgacggaaggggagagaagaaagctttcttccgttatcgcgtatatgacggacggtgtcatcgctacgaatcgcaacggggctattattcttttaaacagccctgcgcttgagctgctgaatgtttcacgtgaaacggctttagagatgccgattacgtctttattgggcataaaagagaactttacatttgaggatttagtagaacagcaggattcaatgctgctggagatcgaacgtgacgatgaaacgactgtactgcgggtgaatttttccgttattcagagagagcacggaaaaatcgacggtttaatcgcggttctttatgatgtcaccgaacaggaaaaactcgatcgggaacgcagagagttcgttgccaacgtgtctcatgagctgcggacaccgctgacgaccatgcgaagctatttagaggcgcttgcagagggcgcgtgggaaaacaaagatatcgctccgcgtttcttaatggtgacccaaaatgagactgagcgcatgatcagattggtgaacgacctgcttcagctttctaaattcgacagcaaagattatcagtttaatcgggagtggattcatatgatccgctttatgtcactgattatcgatcgttttgaaatgacgaaagaacagcatgttgaatttatccgcgagcttccggacagaaatctgtacgtggagattgatcaggataaagtgacgcaggttctcgataatatcatttctaacgcactgaaatactcaccggaaggcgggcatgtcactttctcagtcgatgtgaacgagaaagaagagctgctttatatcagcgtaaaagatgaaggtatcggcattccgaaaaaagatgtggaaaaagtctttgaccgtttctacagagtggataaagcgcgcacgagaaaactcggcggcaccgggctcggccttgcgattgcaaaagagatggttcaggcgcacggcggagacatttgggccgacagtgtagaaggcaaaggaacgaagattacatttactcttccatataaagaagagcaagaggatgattgggatgaggcgtgaaaatataaaaacagtcatactgtcagtgctggtcgtcattagtcttgttttaacatggggaatttggacattccagcccaatttttcagaaggcacggcctcaaccaaatcgactgtccgggaaaagcataaaattgataaaacgagccaaaaagtgtcgcaaacggtaaaaccccgggatatgtttattcatacaaacggctctcattataaagtggatgatgagacgctctttaatgacctgtgggcggatttgccgcaatgggaagtaaaagggatgaaggatatttccgatcaatacgacaagctcggttttaaaaattggctttacggcagaaacggcaattcggcaaagctcgatctgcaattcaatgacaccattccgattgatttcttccaatcgatgtttaaatggtcaaatccgtcaatggaatacagctcatttgaccatattgttattccgtttaatgagaataagacgaataagaagatttacatggtctcgtacagcaagcagctgattttggaagtgactgtggaatcggcgaattaccgcaatctgatgaatgagctgtacagcaaaaagtcgagtatgccgttataccacctctattcggtcggaaaaagcaaagaatttctcatgccgaatgcgcggtttaatatgaaggaaaaagaatttatcactgaaaccattaagacgaacctgtttaagcagacgctttttaatgatccgagcacggtcagagaggacccgaattacaatcggaatgtgctgactgacggaatcagccgtctggaaatcaattcgacacagcggcagattcaattccagcatcggaatttggcacaaagcgcttcttaccaaacgggtgagctgattaagaaaagctataaatatttagaggatacgggaagctggacggatcattatcaatttttcaatgtgagtgataaccagcagctgagtttctacatgtttaaagaccaaatgcctgtgatcaacagcacgtctaagcctttcggatccggacctgttttgaccctgcaatgggccaatgacgaggttctcagctacaagcggccgaactatgttctcgggccgaatccgattaaaacaaaagacgtaaaaatgatgaacggcaatgaggttgtgtctctgctggagcagcaggataaatacgacgtgaacaaaatcgaccagatcttcctgtcctatcaaatggtctcttcttcaacgaatgatctcgttgaactggaacccgtctggagtatgaagatcaacgggaagatcgtcccgattacgaaagatctgctggggaaggaggaggacgataatggagtggaataagacaaaaacgatcttcatcattgccttcctcatcctcgatatttttctcggctatcagttttttgaaaaacgctcgagcagtgaatacgaagtgattaaaaattcaaacgtggaaaaagacatggagatggaccatatcacattcggcaacctgtcttctgattccgcgacgggctaccggctgacggcgggccaaaaggtatttaccgctgaagatattgatgctttgaaggatcaaaagccgttaatggaaatgccggcggatgatcataaggtcacaacgctgaaaatgaaatttaccgatccggtcggtttatcgaagcaaaaaccgcaggaggatgcggaatcgctcgtcagttctaaagtaaccggcggtgaaaaatataaactgtggaaagtcgacaaggatcaaaaacagatcattttttaccagacatatgacggacagtttatttatcaggattttgactcgtccacggatgcgatcggacaggtgattctgcatctgaacgataaaaaccaggtcgtatcctacgagcagaccatgctggagtcattcaagcgaatccagaccgagagcctgattcctgagcttgatgcggtcgaattattgtattctcaaaattacttaaaagcgaattgcgccgttaaaagcgtcaagttcggctatattgcccaatacccgctgacaagtacgcaggtgctggcgccggtatggagaattacaattgaagataagtcaaaagggacgaagaaaaagacacagcaaacgtacactgtgaatgcattggaaagcacagtcattgataacaatcaaaataaataatggagtgagacacaatgggcttgcaatttagcgtgcttgcgagcgggagtaccggaaacgcgttttatctggagacagaggagcattcttttctggtggatgccggcctgagcggtaaagcgatggacgggctgatggagagaatcggccgcaagatagacgacgtcgacggcatctttgtcactcacgagcacagcgaccatattaaagggctcggcgtaattgcgagaaagtacggtctacccgtctacgccaatgaaaagacgtggaaagcgatggagaatcagatcggcaagcttgataccggacaaaagtttttgttcccgatggaaagcgtaaagtctttcggcgggcttgatgttgagtcattcggcgtctctcatgacgcggccgagccgatgttttatgttttccactaccaaggcagaaagctcgcgctgatgacggacaccggatatgtgagcgacagaatgaaaggcatcatccgttcggccaatgtgtttgtgtttgaaagcaaccatgacgtcggcatgctgcaaatgggcagatacccttggagcattaagcggcggattttaagcgatgtcggccacgtctcgaatgaagatgcggcgctcgccatgactgatgtcatcggcgacggcacatcgcgcatctatttggcgcatctgagccaagacaacaatatgaaggaactggcgagaatgtccgtgcagcagacattggctgcgaaaggatttgtcgccggggaaacgtttcagttatttgataccgatccgaaaattccgacgccgctgtgcgccgtgtaatttttccaaatgaatcatgattattaatccgcgatctgacccacactataagcaaatcgagtactcttgaaaggatttgagatagggtggattataatcgcgatgatgaacagtacgcctccgaacagccccgccgcagcaagagaggatactttctatcaagtctgatcggcgtcatcgtcggggccgcgctcatggctttcctgatgccgtactggacaggcggagaccatggagacagcagcaaaagcaccagccggcgtctcggcagcgaacaggtgaaaacagtcaacgtaaatgtcaatgacgctgtcacgaatatggtcagccgtgtatcggattcggtagtcggcgttctcaatatccaaaagactgatatttggggagagggcggcgaagcgggaagcgggtcgggcgtcatttacaaaaagaacggaaacacttcttatatcgtaaccaatcaccatgtcattgaaggtgcgactgagattgagatcagcctgaaggatggttcgcgcgtgcctgctgagctgatcgggagcgaccgtctgatggatctcgcggtactgaaggtgaagtctgataaaatcaaatcggccgcccagttcggcaattctgatcaagtcaaagtcggagaaccggtcattgcgatcggaaatccgctcggacttgaatttgcgggatcagtgacacaggggatcatttcaggcacggaaagagcggtgcccgttgactcaaacggcgacggacatccggattggaatgcggaagtgctgcagaccgacgccgcgattaatcccggcaacagcggcggcgctttgatggatatttcgggcaaggtggtcggcatcaactcaatgaagatcgctgaatccgccgttgaaggaatcggcctgtccatcccgtcaaagcttgtcattcccgttattcaggatttagaaaaatacggagaagtccgacggcctttcctcggtattgagatgaaatccttaacggatattgcgagctaccattggagccagacgctgaaacttccgaaaggcgttaaaaccggggcggtcattatgggtgtcgacgcgttttcaccggccggaaaagcgggtttgaaaaagctcgacgtgattaccgggttcgacggacataaggtcaatgacgttgtggatctccgtgagcgcctgtatcgcaaaaagatcggcgaccgtgtgaacatcacgttctaccgttcgggaaagaaaaaaacagcggaagtcaaactgacagaagcagatcgattacagaaataaaaaagcagcccggacatccgggctgttttttattgatttatttgttaatattatactattgtgaagcagggaggtgaaacacatgaaaacggctgatgtgatcatcgtattgaatgaaatcgagggtgaatgtgaaggaagaattattttagaatgcagaatttaagaaaatgaaacatgtcatattaaacgtcctttttcaggggcgcttttttttatgccttttttcagaagctataaaaaagaactgaacgcgggtcacaacacgttcagttgaaaatggatatatgtagaaaaaggcagacatgaccttagaactttgtgattgaaacagactggtgctgctgaatagcggcagatgaaactgccggcagcttatttgcagatggctccgttttcagcgtttactttcaccaattcagcttagcttccgttttgtttcagataaaagcgaataatagaaggggaagcgaaaaaaataaacacaggctgatacatctaaggagagactgcatcatgaataagttgaaaggcatcaagctgctgagtgcagacggcgagtctgcactcattgattctttaacgatggggcttcatcacggaacggttctcggggaagacaatatcgtcgagacatacattcgttctttgcgcgaaaagctgaaggacaaagaacacaaggtgattcgcacggttcggggcgccgggtacagggtggacctggcatgaaacggctgtacagaaccctgcggttccagctcctgttcaggtcactggcgattttgaccttgctgttatgtttcatcggcggtacacagtacatgtttatgagacggacgatgtatgaaaatcaggcgatcagcattcagagtgatatcaattcaatggatcaaagcgtatggaggtcaatcaaaacccctgcccgttccgaaacaccggctcatccgaatgtgatttatcccggggtgacggttgcttttatcaatcaatcatacaagatgtcagttttatcagaagacccgcacgcgggagccgctccttctttcccgaaaaacgtgtatcgggatgcgctgacagatacaatggcgcttcactatcaggtggctcacaataaggcgggtgaggaaatcatcgtcgtgtttcaggcgatttccgttgacggaaggcaggcgggagttgtacagatgagcacgctgacccagcctctgaatgattcgcttttccgccagatcagcattttcgcgatactttcctttgcggctttggttatcggactgtttgtttttttgccggtgatccggctcacactcaagccgctgtcccgcattgtgcatatgatgggtgacattcatgccggcagtctcgataaacggctgccgattgataggaagcaggccgaaattgagtcattgggcatctccatcaatcagatgctggaacggattgaaaccgcgtttcaggcggaaaaagaagcgaaggagcgcatccggcggtttgtatcagacgcatcacatgagctgagaacgccgcttacctccattcacggctttatcgaaattttaatgcgcggagcggcggaaaagccggagcagaaagaaaaagcgcttcaaagcatgtacgcggaatccgtcagggcgaataagctgatagaggatcttttgtttctcgcgaagattgaccgggagccgagctttgaaatgaaaaaaggggcattgggagacgtcattttggaaatggaggctgagctgaagctgcttgcgagaaaccggaaactcgagttctttgttgatcaaaagatagaagctgtttttgacaaagacaaaatgaagcaggccattctcaatctcttttacaatgcggtgcagcatacggatgaagacacgggtgtcatcaccgtctccctgcagaaagacggaggaatcatgcttatgattgcggataacggaacgggaatcgctccggagcatgtgcctcatgtgtttgaccggttttacagggcggaaacctcccgatcccgtcaatccggcggcgcggggctgggtcttgccattacaaaaaccattatcgacagccataacggaacaattgaagtgaaaagtgagcagggaaaaggctccgtgttcatcatccggctgccgggataaaccgggatagcggaagaaatatcacaatttatatataaattctaaattttcaaaaaataacttgtccttttccaatattgatgataatatctagttattggcaaagggggtgtgtactgatgaagattgaagaacttgatcttgatacagaaacagcaagcttggtgcatcgctgctagtaaagccgtgactcccctttttggggagttattatctttcagggggtatgtcatgatgtcaacggactgtaagcgctggaagtttaaagacagcgtgcaggtgctgacctacacggggcatattatcattcaatatcgaaaggcgattaagcttgcgcatacgagtgagatcaaagaggcggttgaacggctgatcaccggctgtgaaaaacaagagctttctgatcttctgggagaggaagcgggaaaccagtttttcgatgcgttaatgaaattggatgctttaatagagccatggcaaaacggccgtgaaggctgcatcactgaaaagcagctgtaccattttgagaaatacaaccaaaaccccaatctgatccaaaacagattagacggcagcagggcagcgatcgtgggtctggggggcgtcggaacgatcattcttcaaaaccttttggcggcgggcatgcagcattttattctcattgatttcgatgccgtatcagtacataacctgaacagacaattcgtctatactcaatcttctgtaggcaaattaaagatctcagaatgcagagattatatcgcgggtatcaatccccatgcggacgcagcactttaccatcaggaaatgacacagccgcaggacctgcgtgtgttagatccgtacgaaattgatatcgtcataaatgccgctgacaaaccccataacatttctgaatgggtttatcagtattgtaaggagcggaatatcgcgtttatgaccgggggtgtcggcagcttcagcggccaatgggggcctctgctcacgcctgaatcctatcaatccggcgtcacctatgaaaaaaacatgccggccggacttctgaactgttaccccgatgaaccgatcaaaggttcgttaggagcgacaaacggtattatatcctcgtttatgtctcatgacattatcacataccttgcaggcggaagcccgaaatccctgaatacccgcatcggcctggactttgacggacttcatattacagaaacgaagctttctcaaaaggaaagcgctttatgaagacgatgcatcgtacggcgagaaaaccgggcgaccctctgaaaatagaaatcgacacaagcccgatacgcttgaacccattagatacgcaggattacacaagcaagatgatttgcagcattatgtatgaaagcctgcaggacggctataactgccgaatcatccgcaaagatcgccgcacctgtcaggtggacattcacccggactatttaggtgacgccgagggtgtggttcaaacgatcatctatcatctgacaaaagaaaaccaaagtccccatctcggcagtttcctgaacataaaacaggccgttccgtatgtaaaaggcctcgtctcatccgatcagctcggggtgaacgtaacgggcgaaaaacgctttgaagtcaccttggacgagccgtctgatgaaatagaagccgttttgcagagcagctttctgattccggcgaccgccgggggcgatgtgccggaaaatggcccgtaccgattcaagcgtacgtttgagaagggactggaatttgagcggaatccgcaatataaaatgacgcccgcggatcaccgcaccgttcagatcatccaatttattttgaatgatgatctggaaaaaagcatctggctgtacgaagcgaatcagaccgatgtgacctgccacacccagtttcatcattccaacatgaggtatcggcagtatgctgattttaaagaaaatcatttgccgatgttatttaccttcaaggtaaaggacggcatgctgagaactttcattcagcattattttgataaacaaaagctggccggcgatttggggcatatcatcacaccgactgattcactgatcggtatatgggaaagcggacggacaccgcagaaagatccgccccttttgacaaaagaagagccgatccgaattgtttatgccgattattatcccaacggagagatcattgaaaggctgactgaattgtttcggagggccggagcggacgtatccgtctcccgcgtcagtcatttcaatgattattaccatatggataaaagcgggtttgatattgagcttcatttgttcctgccggcttacatgcatgagctgagctatatcaaatatttcattcgcgacatcagcgatccggggaagaaaaaaacgatcattgatgccataggatctgaaaaaaagaaggaactttttgggttattcgagaatacaactcattattgcccaatttgttttgggaaaagtctgtatctgcaagatccatgtatagagggttttagtgtaaagactgacgggctcctttctgttcatgatgttaaatgcagatagctggaaaggggtattcatttgcggaatcgaaatttgctttacttctccggttttttcggaaacttctttttcgaacggggaatttggattttatatttaacaagcatgaattattcattgtttctagtgggcatcctgcaatcggtcctgaatttggcgatgtttctggcggaagtgccgagcggcgtcatctcggacagaatcgggagaaaaaaatcgctcttgctcggtcattttatggtcattgtctatttggtgatgttcctgagcttccataacttcatcgccctcttcatcgctcatattatatacggtatcgggctgacgtttatatcaggaacggatcacgcctttttgtttgattcactgaaagaacaagggaaagaaaagtggtacggcaaatccatcggaaattataacggacttgtcatactcggtcttgcgatcgccatgggcatcggcggctacttgcaggaaatatcatggtcgtatgtgtttatcgccgggattgtgactcagctgattgcgatggcggtcattacacagctgacggagatcaaatttgaaaacagtgaacacgaaacgcagacggtcggggacatcttaaaagaagtcaaagatttcttcaggctgaacaaagcctttaaatatttggtgctgtcactctccgttttctttgcgattacatcggttttttatatgtacggacaagatctgttaagtcaggaagggctgtccgtgcgcaatatatccattatttttgcggggctgtccatcttgcaggcactgtgctccatcttttcttcaaagccggcggaaaaattcacgccgaggcgcgtgcttctgctgacattctgcatcatcggggcggcctatctgtttataccttcgggcagtctgtacgtgacgattgcagcttttgttgtcatcaacgcgctctatgatgtgatagaacccgtatccagtcaggtggtgaataatgagattccgtccagaacgagagccacgctgctgtccattatcagtttgatgacctcgctcttcatgttcattgcctttccgtttatcggattcttaacggactattttgattcagctttgctgctgaccgcaatcggggtattatccatcttattgtcgctgtttatgatgctcagcttttacaaactgaaagcgagcgtcgccatccagaataaagtcgagctttgaaccagaatgacaaagggatgatgtgagttgctgaatattcataatcttacggtaaatttagcgggagataccattttcaaacaagtttctttcttcatcaatgaaggcgaaaaagtgcttgtggccgggccgaacggttccggcaaaagcacgctgttcagggtgctttcaggggagcttgaggcggatgaaggaacgattgcgatcaacaaaggggcgaaggtcggtttgctgaagcagatcgctgatccccatgaggatctgacgttgtatcaatatctggaaaaatcgtttgaagctctcgcggcgatccagaaggaaatgaaggccattgagctgaagctttcggaaccgatgggtgaggacgagctgactgctttattggaaaagtacagtcaatacacggaaacatttgagcggaacaacggctaccagatgcatgcgatgattgacgaggtatgcaacgggctcagcctcagcgaattaaaggatcagccgttttcaaagctgagcggcggcgaaaaaacaaaagccggccttgccgaaattttaatccgcaacgacgacattatactgctggacgagccgaccaaccatttggatgttcatgcgattgagtggcttgaagggtttattaaaaaatcgaataaaaccattctgtttacgacccacgataaaacgtttgccgaccagacggcgatgaaagtgctcgagattgacgataccgaggtgaagatttggccttacggtttcagcgaatacctgaaaaagcgggaagaattcatcatcgcccagtttgagaaatatgaagaacagcagagaaaaatacagaagatgaaggaatccatcgcccagctgagagattgggccaaccgctcgaatccgccgtctgtcgggctgcacagacgcgcgaataatatggaaaaggcgctgaaaaggatcgagctgatcaataagccggtccggacggagcaaaaattaaaaaacgcatttcaggaagcgggcgccggttcaaaagatattgtgttcattgaaaacggaaaggtggccaacggatcttcccttttatatcaaaatgtgaatctgcgtataaagcataaagacagaatcggcatcgtcggcagaaacggcgtcggcaaaacaacgctgatccgctgcatcatcggggaaagagaactgtcggacggcaccattaaagtaggggaaaatcttaagataggctacattgatcaaaagagccacgtcggagattcgagtcagacgattctgcaattctttaaagaaaatctgctgactgaagagggcatggcccggaatatgctggccaagtacggattttacgggtcgtcggtctttaaaaaactttccgtcctgtcgggcggtgagagaatcaggctgaagctgtccatcttaatggaaaaaaagctgaatgtcctgatcctggatgagccgaccaaccacttggatattgaatctcaggaaattctcgaaaacagcctgatgcagtttcaaggcaccatcatctgcgtttctcacgacagaaacctgctggagaagttcaacaagattttctggcttgagaatcaaaacgtcaccatcttttcaggtccatacagttacgccaaacaaaaaaaacggcagattgccgaataaaaggggaatggatatgaccattgacagactgacaatcaatgagttatcgtacgatctttttgtaagcgagtatgctgataagaaaccttttattttgacgggggcaatggatcactgggaatgcaggccgtggacgcttgaatacattgacgaacactatggagacagaatggtcaccatccggaaatcagatatcgaaggggtcaaaacgtttaaacaagtaaagctttccaactatatcgagtacattgatcagaatgatgacaaatggtactgtgactggaattttacgcagctgaaccaaaatgacttagaccttgtctattccgcacccgagtattttacaaaagacacattgagagcggatgaagaaacgggacgggactggaaatggttctttctcggttctaagcagacaggcacgccgctgcatcaggattttaacagcacgcacgcgtggaacggcgtcattttcggggagaaggaatggattttctatcatccggacgactctccgtatttgtacgaaggaaatatcaatgtctttgatgaaaaagatatagagcaaaaaccgctggcgcaaaaggcgtctccgatccgcttcaggcaaaaggcgggagaaatcatttacgcgccgcgccattggtggcatcaagtcgagaatacggaacatacattggcagtgagtgagaacttttggtttaccggagagcggcttgccaatcagatataaacgaaaggctgaggagcacctcagcctttttttgtatggattcatttcatccggtccagaccgaattttttcaggcggtattgcaggctctgcctgctgattccgagctcgtttgccgttttggatatgttattgccttgttttctcagggttttttcgatcatgtatttttcgaagttttccattttgtcttttaaatctgtgccgggctgggtgcttgcggctgctttgctttccgtgtcagcgggtttgattttcatccggtattggtaaggcaggtgggccgccgtaatcgtcgtttcatccgtcataaagttcatggcgccttcaatcatatgttcaagctcgcggatgttgcccggccagtcatactccaggaaaaattgctgcacatcgtcactgatcgaatcgacatgcatttgaaacaggtggttgtttttctgaataaacacttcggccagaggcagaatgtcttccttgcgctcccggagcgggggaatgatcagcgtgacaacgcttaagcggtagtataaatctttgcgcagccgctcttctgaaatggcggtgatcgggtcttcattcatcgtggcgatgatacggacgtcaatcggtttgtcctgagctgatccgatgcgcctgattttcttttcctgaagggcgcggagcagttttgcctgcaggctgagattgagagagttgatctcatcgaggagcagggtgcctccctgcgcctgctcaaataagccgggctggtcgatggctccggtaaaggcgccttttttcgtgccgaataaaatactttcgaccagactgtccggcagggcggcgcagttttgtgagatgaacggggcgcctgagcgctggctgccgttgtgaatgctttgggcgaacagctccttgcctgttcccgtctcgccggccaaaagcacggacgatgatgtacgggttgcccgtttcgcgttttcgatgacttcctgaatgaccgggctgttgccgagaatgctgtcaaacgtgtagctgttctgttcttttctgtgcatgttctccctgatcagccgttcgagcttggtgacgtccttggcgatttccacggcgcccttgatctcgccgttttgcacaatcgggaaggtgtggttgatcgtcgtgatttcctggcctttgttattgaaatagctctgctttacatttttaatcgttttgccttcttgaagggcctgaacgagcgtgctgtcctgctgattggaaaacataaatacatcagtcaggtttttatgcaggacgtcccgttcatccatatcttcaatctgcatcattttcttattgtaaatgacggtgctgcccttctcatccaccacatgcagcccgacatcaatctcttccagaatgctttgtaacacgagtgtgtaaaattcgctggttgtgtgcaggtcaattccccctctcaatcgtcttaacattcattattttaaaataaatcgaacaggaaacgcaaaaaaattttgcgcttggctgaagtttgcacgcaaactgccggaatattttgcaggaaaagaaagaatgctggcgaaacatcccgttttttcggattggcacggaacttgctttataaaaagggaaagcaagatctaatgttgaatgattacaaaacaagggggaatcagattatgtcagctttcacaaaatctcaagaaattatcagtcaaacttcacattacggcgcgaacaactatcatcctctgccgattgttatttccgaagcgcagggtgtttgggtaaaagaccctgaaggcaatcaatatatggatatgctgagtgcttattccgcggtgaaccaggggcacagacatccgaagatcattcaggcgctgaaggatcaggcggataaaatcactctgacgtcacgcgcgttccataatgatcagctcggcccgttttatgagaaaacagccaagctgaccggaaaagatatgattctgccgatgaatacgggggcggaagccgttgaatccgctgtcaaagcggcgagacgctgggcatatgaggtcaaaggagtagcggataatcaggcggaaatcattgcgtgtatcggcaacttccacggcagaacgatgcttgcggtatccctttcttcagaagatgagtataaacgcggtttcggacctatgcttccgggtataaaattaattccatacggggacgcagaagcgctgcgccgggcgatcacgccgaacacagccgctttcttattcgaaccgattcagggagaagcgggcatcgtcattccgccggaaggatttttacaagaagcggccgctatttgtaaggaagaaaatgtgcttctgatcgctgatgaaattcagacgggactcggccgcacagggaaaacattcgcggttgattgggaaaatatcgtaccggatatgttcatcttaggcaaagcgctcggcgggggcgtcttcccgatttcgtgcatcgcggcgaaccgtgacattctcggcgtgtttaacccgggttcccacggctcgacattcggcggaaacccgctcgcttgcgcggtatcgctcgcatctcttgaagtccttgaggaagaagggctggcagagcgttcccttcagcttggccggtattttaaagaagagcttgagaaaattgataacccgatcataaaagacgtgcgcggacgcggcctgtttatcggtgttgaactgacagaagcggcccgcccgtactgtgaaaagctgaaaggcgaagggcttttatgcaaagaaacacatgataccgtgatccgttttgcaccgccgttaatgatttccaaggaagacttggactgggcgatccaaaagatcacaaacgtgcttcaaaacgcgtaataccttgatgcggcaatgctttccctcggcttgtatggaatttacaaataaaaaattcagcacactctatttgcgcggagacagtattttagtataatgtatctttatgtacgaaaatgaatttcatataacattcatatacaaatagaggctctttggacagcaaatcggtttcaaagcaccggcttggttccaatacaagttgctgaaggggtgcagaatagtgaatacaaatcaaaaagagaatcagcttcagcgcacaatgaaatcgcgccatttgtttatgatttcattaggcggagtgatcggcaccgggtttttcctgagtaccggatttacaattaaccaggcgggaccgctgggcgcggttctgtcttatctggtcggcggttttattatgtttttgacaatgctctgcttaggcgagcttgcggttgcccttcccgtatcagggtcgtttcagacgtacgcaaccaaattcatcagccccgctttcggtttcgcattcggctggctgtactggctcggctgggcggtgacatgcgccattgagtttttatctgcgggacaattgatgctccgctggtttccgcatgttcccgtatgggtgtggtgcctcgtgtttgtcggactgatgtttcttttgaacgcgattaccacaaaagcgttcgctgagtcggaattttggttttccggcattaaaattttagtcattctgctgtttattattttgggcggtgccgccatgttcggcctgatcgacatgaaacacggcgagcaggctcctttcttctctcatttttatgaggatggattgtttccgaacggcattaaggctatgcttattacgatgattaccgtaaacttcgcgttccagggaacggagctgatcggggttgccgcgggagaaagtgaaaatcccgagaaaacgattccgcgctctatccggcagacggtatggagaacgcttgtctttttcgttctctccatcatcgtcattgccggcatgattccgtggaagaaggcgggagtggtcgaaagcccgtttgtcgtggtgtttgaacaaatcggtattccatatgcggccgatattatgaactttgttatcttaattgcgctgctctcagtggccaactcaggcctgtttgcatcgacgcgtatcttatatgccatggcgaacgaaggacaagcctttaaatcgctcggcaaaacaactaaacgcggcgtgccgatgaacgctctgatcgtgacgctggccgtcgcctgcctgtccctgctgtctaaagtggcagcgccggaaaccgtttatatgtttctcttatcattagccggactaagcgcgcaggtcggctggattacgatttccctgtcacagctgatgttcagacggaaatacatccgcgaaggcggcaaagtggaagacctgaagtttaaaacaccgctgtacccggtgctgcctattatcgggctgacgttaaatacggtcgttctgatcagtctcgcatttgattcagaacagcggctcgccctttattgcggcatcccgttcatggcggtgtgcgttatcgtctatcatctgtatgtaaaaaagcataagcagtcagaaaaacagatagagctttaaatcttttcgtgtccaagtcatctttgagaaacccgcacaggacaacatacaacatgttgaggtggaaaaacggatgaacaagaatatctcagttattggaatgccgatggatttaggacaagcacgacgcggagtggacatgggcccgagcgccatccgctacgcgcatctcattgaacggttatctgacatggggtatgcggtggaagacttaggcgacatccccgtcaatcgtgaaaaactcaaacatgatgaagagctgaaaaatttgaactctgtgctctcggggaacgagcagctcgcccaaaaggtggacagcgtcattgagaatgagcggttccctctcgtcttgggcggcgatcacagcatcgcgatcggaacgctgacaggaacggcaaagcactataaacagctcggcgtcatctggtacgacgcgcacggcgacttaaacaccctggaaacatcgccgtcaggcaatattcacggaatgccgctggccgtcagcctcggcgtcgggcacgacacgttggtgaatctgggcgggtatgccccgaaaatcaagccggagaacgtcgtcatcatcggcgcgagatcgcttgatgaaggcgagcgtgaatacattaaggaaacaggcatgaaagtctatacgatgcatgagattgaccgcctcggcatgacaaaggtcattgaagaaaccattgactacctgtcagactgtgacggcgttcacctcagccttgatctagacggccttgatccgagcgacgcacccggcgtaggcacgcctgtcgtcggcggcatcagctaccgtgaaagccatttggcaatggaaatgctgtatgatgccgacatcatcacttcagctgaatttgtcgaagtcaacccgatcctcgatcacaaaaacaaaaccggcaaaacagcggtcgagctggtagaatctttgttaggaaaaaaactattataaaatatgcgcctccgcacctgcggaggttttttttgttgccacgaggaaactagcgggctgccaccctctttttggacctgtaaatatgatatatttattacacaaaatgggaaagggaggtgtcctgacagatggctgaggtgatggcccacgaaacagttgcgaaaaaaatcagtgactggtatgaggaaatcaaaaagcacaacactgaatcggctgaggcgttaagagaacaactgcttacggatctgcaaaatatgacacaaaatcaaacggtgctcctttattttaatttaattgattcccgctataagcttttaatggaagagtatgagaaaacagacggcattttaaaaacgatccagctgaacgccgataaagaaaaaacagaccagatgattcaatactattattatttcttttccggaatgcacgagttttaccgtaaacggtttatgaacgccattaatttttaccggattgctgaaagcaggctccggcacataccgaatgagattgaaagagccgagtttaattatcaagtggcgattgcctactatgaaatccgccaaaactactttgcgatgaaccacgcggaaaaagcgttggagatctacaaagccaatgaaatgtacgcggtcagagaagcacagtgtttaatggtgatcggctgtaacagaatggacttgttccactatcagaaagccgaagagctcctgcagacggcggttcatcaagccgccaaagcgggcgatccgcatattgaagcgctcgcccactttaacgcaggcatttgctatgaaagacaggaaaaactggaagaggcgcgggtcgagtttgaaacggctcttgatcaaaaggagcatttgcgatcagcgtattcggtgcggagtctgtacatgctggccagagtgttattgaagcaggcaaagacggatgagggccgattttggctgcataaagcgctgaatgccgctgaagaaaaaaacgagcccgtatacacccaaaagctgcgcatcttacagcatgtctttattgaccgcaatgaagaagcgcttgaatcagctttcgccgagttaagaaggaaagagctgtggagtgacgtttccgatttgtcgtatcaggccgcggcgcattttaaaaaacaggagaaatacaaaccggcggcgaagtattttcaggaatcaattgatgccaatgaccaaattttgagattaacggaggggattcgtaatgaaaacatgtaaattcattgtactctcagcagccttggcaagtctcatttcgattggattatttgcacaaactggttcaacggcacaagccgaacaaatcataaaaccggcggaaaacggagccttcggataatactgcatgatatcgctttcgtgtaaggagtgattcaatggctatcacgctgcagccgatgacaggacaagagtttcagtcctatctcgctcattcaaccaagcattacgctgaagaaaaggtaaaagcgggaacgtggctgcctgacgaagcgccggaattagcggagctgacgtttgaagacctgcttccagacggcttggagacagccgatcactatttatggacgctgacattggacggaaaggaaaatgccggctggttgtggctgcacgccgatccggaccacccgcagcaggacgcatttatttatgatttcggccttcatccgcctttccgcggcaaaggctatgcaaaagaggcgctcgcaaggctggaggacaaagccaaagatctgggtgtccgcaagatttctctccatgtgttcgctcataacgaaacggcgcggaagctgtatgagaagacgggattcctggagacggatgtcattatgagcaaaaagctgtcatgaaaagaggcccgcacgatgggcctcttttgttattcatctaacaatgtcatcatttgttccgggtaacgctcgccggccgccgtgccgatcggaaacatttcatccaaccgcgccttcacatcctccggaagcacaatgtcgagagcggcgaggttctcttccaagtagtgtttcttttttgtacccggaatcggaatgaggtcatcgccgtttgcgagaacccatgcgagcgcaagctgaggcgcggtgatattcatttcccgggcaatggcggtaaatttttggacgagccctatattcaccgccaaattgtctccctggaatctcggcgttcttcttctgtaatcatcggcatccagctgatctgtcgacgtcatctttccggaaagaaaacctctgccgagcggactgtaaggcacaaatgagatgccgagctcacggcaggcgggcagcacatgctcctctgcttccctgctccataaagaatattccgattgaagcgcggcaatcgggtgaatgcggacggcgcgcctgatcgtttctgcggaagcctctgacaatccgatatacctcacttttccttcgtcaatcagcttcttcatggcgccgacagtttcttcaatcggcacccgcggatcaacccggtgcagataataaaggtcgatataatccgtcccaaggcgtttcagactggcatcacacgcttttttcacataatcgggccgtccgttgatttcgataaactcacccttttcgcttcggacataaccgaatttcgtcgcgaggcacagctcctttctgaatggggcgagcgctctgccgacaagttcttcatttgcacccaatccatattgatcagccgtatcaaacaaattcacgccgagatgaacggcatgatgcagtgtggagatcgactcttcctcactctggctgccatagtattccgacatgcccatgcaccctaatcccattgcggaaacccgcatcgaaccgatcgttctgtccttcatatgtcctccccctttcttgtatgataaccagatttcctgatatttgaaaatgatttatgtatatgatttacatattgttataaaatttttaaaaatctgtaaattgtatatttttttatcacaatttcgtcatataatgaaaacgtggaaaaattaacctttgagaaaagaggcgaagtcaatgtgtaaaaagctgttcaaagccgtcctcccgtttgccctgtcattcaccatggttctgtcgttctccggtttgaatgtaaaagcgaaagaaacagaaataccacgctacgcaaaagaaatcgcagaccttcagcagggcacgactcctcaagacgttctccaatccgccaaagagcttgccaaacagaagcacgtttcaacagaagcaattctcaagcagtttcatcaagaaatcacggcagacaaggtgcaaggaaatgtaatcgcttccaaagacggactctctgcgatgggcggatcgtcaggaaccaaaaaactcccgaaaagcacaaaaggcaatatttattacacgaactcatacacggcttattacaatcacgggcatgtcggcatgtattcatccgctgataaaattgtcgaatccgtgccgggagacggcgtccgtcagattgcttataacggcagagaagtcgaagacaattcaatcgtccagaccgtgaaagttaccgatgctcaaaaacaagccgccgctgactgggccgtatcaagagtgggtgatgagtactccttcaacttcgtcaataacagaaatacgggccatgaaggcgccaaaaactgctcaaaactgctgtggtcggcattccttttaaaagcggggattgatatcgactctaacggcggcttaggcgtatacccgcgcgacatcacaagctcgtcctacacaaccacgatcctgaccattcactaaggagaacaacgtgaaaaaaatcatctggatacccttagtgatcatcgccgccgcagcggtcttatgcttcttctatttccgcacggaagaccctgcggaggttgcgagagacacattaaatgaccctgattttctgaaagataaagaggcgttgctgtatttctccactgcggctgaccaagacacgttcggcggcggaaaaagctacgccctcttcgccgatgaaaaagggcggctttcttcttatcaaatgaaggggcttgagctcggatcggccaaagtgcatgacgaaagcgtgctgctggaggacaaaaaaggaatctacaccgttcaggacggccttcacacgtataaaagagcgtaccagcatacgggagacagcgcgggatatatcgaacgggcgaaaggcttttacacgctgtataattcgggctacgacaagagcggcggcagctatcgctcagagctgtaccgccagatggacggcaggtggaagcaagacgtcatcccgcactatatccgcgcctcaggcttttttaaagatcatcttttcgcgctcacgccgacagatgacgaaaaaggctatcacgtccaagacattcaggccgataaagaaaagctccatacaacatcaatcgcgacgtggacgtataaagaaggcacgtctgtcgaatcccagctcgccgtggacgacagcgctgtctgctttgttaccagaggagaaaaagccgatcacatctatcaaatggtgaaagtcatgaaaaacagcggcgccatcaaaacgtatgacatcgccgcttataaaaatgacgaacagacgatctatgactccatgccgttcagcttcaaaaaaagctttttcatggagcatcgcagcttctatttcgttgacggcttcggaaccgtctaccgcatcaaccctgagaccggaaaaagcaaaaaggccttcaccctccccgcatcacgaatgaaggccgacttcaaggagctgacccatcaaaacggaaagctgtatctgttcacgtacagctacaaaaagcccgccaaaatcgaatccttcgacctgaaaacgggcaaaaagctgaacgacctgaccatcccaaacttaaaaaacatcgtcacgccgaaaagccatctcaagctgtatgatgtgcaggtgatggatgggttttaaagagtatgaacatttcggaagagcttgccgcttttggtaagctttttataatgaaacgttactgcgggaaagaaggtgttcatttgaaatcattcagtatcttcttattgttgtccgtcatttgtataaccattgtttttgtcataatgaatatgttgattggataccctgatgtgagtaacggggcattgattatgattgtatatatcgttgtgaccctcatgataaggctatatagcaagaaaaagaaatagaggaatttgaaccgtaaaagcagaagacagtcagatgaaggagggagccgatgaagaaaaagcttgccgcggtgaccgtcaccattctcctggtttccgtgataaccaactcttttttaaacggcggaaagccggactggattgatgtatgctgtacgctgctggcgtgtctattaggaattctgttcgtccttcgcttagaaaaaagagaaaacacgtaaagagccggatgctgaaaacaccggctctttttgcgcgtgatttgccgaattgtggataaaactcagcccgaagcactactaacatgtgtataaataggttatattgaaaagagaacaattgccgcgcgcaaaagaaaaccggaggatgtaacaatgaaaaccgcttattattcttgtgaagaacatatcgaaaccgtgctggacatgtacatagatgatcatgagcttccgcccgaaatcagaaaaatcgaacatactaacagtttatccacagcctgtgaattatgtggggacactgcaacatatctagtagggaacgaatgatcctacacaaaatacagaaaagatatccacaattgtggacaatatatatgaataacttgtttctaaagtggggatgacctgtgaatatcaatattgtgaccatcggaaaactaaaagaaaaatacctcaagcaaggcattgaagaatacaaaaaacgactctcagcctacgcaaaaatcgacatcatcgaactcccggacgaaaaagcgccggaaaacctgagcgaccaagacatgaaaatcgtcaaagacaaagaaggcgaacgcatcctggccaaaatcagcccggacacccacgtcatcgccctcgccatcgaaggaaaaatgaaaacatccgaagaactggccgatacaatagataagctggcgacttatggaaaaagcaaaatcaccttcgtcatcggcggctcactcggcctaagcgacgccgtcatgaagcgcgcagacgacaaactgtcattctcaaaaatgacatttcctcatcagctcatgcggctcatactagttgagcagatttaccgggcgtttcggattaatcgtggggagccttatcataagtgagtgaggtttgcaaataccattttcttgatgtattcagcataaaaataatcgttaaggatcatattttgttataatatattcatatggaaatattatgaatgaaaggatgaccattttggaaagaaaaatagatttacttatgaactcgcgtttcggggagagggtagccgaagaggatgagaatttagcatcgtattttgttgaaacggcagtatggaatcaattgttgatgggggaaattgatgtagtccgaggagtgaaaggttcaggtaaaagtgcattatatatgcaattattaaaaaaagagggtagttttgctgcgaaaaacaccttattaatacctgcagaaaacctagagggcacacctgtttttaaatctgttcttggtgatgctgatttaactgaaacctcgtttcagtacctatggtctatctatatcattactctgataggtgataaaatcaaagattttcgtaatagaagcgaagaagtaaaagattttattagaagacttgaattagaaggtttattagaaggtaaagggataagacgtctccttacgaatgttagagattatgtttttgaattctttagaaatgtaaaagaagttgaaggagtagtaaccgtagaacctacaactaatatacctattttaaaagggaaaatctctttaaatgaaccaagtaaagaacatagagaattaggagctatatcaatttttgaacttcttgaaatggctaatgaggcacttaaaagtgttgacttaagcgtttggataacatttgatagacttgatgtagcatttcccggaaaacctgaatttgaaaccttagctctaagaacactttttcaggtttacaataatataaaactgcacaaacatataaaattaaaaatctttattagagaggatatttggaaacgaattactaaaacgggttttagggaggcaagtcatataacaaagcaagtgacgattgattggtcagaacaggattttttacatttactggttagtcgtattcttgaaaacgatattctttgcaaattttttaatgtggaaaaagatgatgtattaaaagatagtgacaagcagaaaaaaatattctattctattttcccgaaaaaagttgaagtaggaaagaatcctgaaacatttaaatggatgattggacgggttaaggatggattaaaaataacagctccaagagaactcattcatttaatgaatgaggctagggcaaaacaaattaaattgttagaaactggtactccagaaaactcttattcagaaatcataggacgaagtgctttgaaggacgcattaaaagtagtatccaaaattcgtttagagcaaacaatttatgcagaatatgcacatctaaaaaaatacatagaaaaacttgaagaccagaaaactgaacatgatgttggtaccctttcaaaaatatttctaataaacaaagaagatacaataaatattgcaaatgaattagtgtctattggattttttgaggaaaaaaagggtagtcataaaccttattggacaccatttctatacagagccggacttaatatggttcaaggtaaggaagactaatattatagagataagagtaaagggggagtataaagcttccctattaattttttatgcttaagtaactctatattagatttaaaaaaattcacataaagctacatcaattctcaactgtcattagtcttaattaagcttgttaccatagggatgtttcgaagactttaatcaaaaatgattcaaatctcacttagatagagactatgataaattttatattatttaagtcgtcatttaattaacgtttattacaatagaaatataatctatagagggtgttgaaatttgaagaatgacattttgttacctaataaaattaaagtttttataagttcaaggtgtggacaaggttttgaaaggtatgatgaagtaagaaaacaactaaaaaaacttatcgaatcgacaaagattgctgatgtatatctatttgaggaaagtggagcttcgacacagtccgcagaacaggattatttatatgccctagatgatagtgatgtatgtctattcttaatagataataaagatgatgttacatctgcaattgttagagaaataactagagccaaatcacacccaaaaaagtcaatatatctattttgtaatgaaaaagaaagtaaacctacgcaaatccaagaagaacttattggagcaaaaggagctaaatattatatagttaatagttttaatgaatttgcaaatcaaggatttaaagatttaataacagacatatgtaatatttatagacactattgtaaaaatagactcatagaccaagaatttcacaattctgaacagaataaaatagaaataggttcaatagcttctgaatcactagagaaacgtattttacaaggaattgataaatcaaaagcatatatcggaaaaaagatattttctgttaataaagaagtgaaagaaacgagtgaattagatagattttatgagcaatttctaaaagtattatttggtgaaaaaagtattgaagaattcaatggggatttatttttagagcaaataaaaaaagagcaaagtgataatatgcatctagtagtaaaattaagatggaaagctattcagttttactggctcgatgattttgattctgtattaaaatacttaaaggaagcttttgacttatgtaaggaaagtgggttgcctgattggatttcacaggatatactgatagatttaataaatatagaaaatcaaaagttaaatcaggaaaataaattctcctctaggaatgctgcacaagaagagttagaaagtatgcgtcaatctctgttttacccatcaattgatagatatgaaaagctattatataaagaaattaataaagcatcaacaaaaaagaaaactgaaactgtgtatactgttaaccttggtagtaatttagatgtttatattaaatatttgactaacatttatattgttggtgcctttaatggatctttaactcaattattattattgagaaataaaataaaagatatatcatttcaattatgtgaggaatattccaattgggaattcagagtgttgctgttaaaaatggcagtaatagttggagatagcaagcaaacagaaaatataatttcctactttaatagcatattaggaaaaatcaattatattgatgtaaaaaatatttataattttacaaactgcctcccggtaaaatcagaaagaataaaatctaagctagaagtatttaaacatttagggtattattttagcgatgaagattacatgtgtatcaaaagagagttattggaagagattcataattatattgataatacttttatagtgtctatgggaaaattaatatttgattctttgaaagaaaatatcaatagaatcgaagccgatgaaatatctagagtatgcataaaaattttagaaaaaaagatgtttcgcttttatgatgatgctttaaatttgataggaataataagttttaaagggatatctactcaaaaccttgaaaaaataaagaatttgttgaaaggaatcattttagattctaatctagcaaaccagtgtcataacctcttatatgcaattataaatttaagaaaacagataatagcgggtacttcggaattaaatcaagttgtattaagtaacatgtctgaatcagatcgcaaaatttataatttagaaacatctagtgtcaaaagagaaagccatattatgagttatgttcaggagatcaaggaacaaattgagaaacaaggtaaaaatgggatttacagtgtgaaagcgcaaaacccatatctaataatccaaaatatcattaaagagggttgtgaaatagttgataactatctattaaatgaagttcttcaagtatgtaatgaatcgttatgtgcaactaatctactgtattctgataaggtgagtgctttacaattaactatttatattaaacagaatttccaaaatattgattataattttaaagatttatatcaatatttgattaaacacgaaaaccatctctttgaaggaaaagatgatctttttcaaaaatattcgacattaaccgtaaagattaattattttatgcttaaaatggtatgttgccaactagataatgttgatttattaaatctattaagtgaaattaataatgaggatgagtttgaaaaaatccaatgcttaaaggccattataaatgctataaataatgaatcatttaaaaatatagaatcagatattcgtagtatcattattcaattcactttaagtttgaagaatgacaaaaatcaagatatacggtatttatcaattaaagcattgctaaaaatgataacaaccaaaactcaaaaagttatactgactcagctttcacaatctatggattatgaaaatgtatatataaaaaatcttataataggaaactttgaaaaattagcaattatagattccaaagttaataatttaatattgaagaaagcttccatagataatcattatttggttaggacagaagcacaaaaatatatacagactagagcaattaatattactcaataaacttgtttagaaaaaaagagataataaatgtgaatcaaataatttactttcaaatttgaaaacaaattattaaggagtaaatacatgaaagaagaaatgattttaagaaaggtgatttattttttatcaacggcagaaacaccaagggaagtatttttagtatggaataagcacaaggaacatttaaaatactttaagttgagtataaacctagataattatgataaagatactttcccggttggattgggagaattggtaaatgcagttgatcaagactttatttcttactttcaaaccggaaagttatattacatggatgatgaattactgaatgatatgttatttaatggaagtatatcatttcctattgactattctgtgatgttagatactaattatgctagttatattcctcgctttttgaacaatcaagggagtagtgaatttgagaaagaaagtatttacaaaactatagatactctactaaaacataaatttcattatgattataatttctatttagtagaaaattataataaaattattaaagataatgggagttttgatgcttctataaaaaaacatagggatatgtacgagaatttagtatttttagagctatttaaaagcattgataatgatatatacataaataagaatattattgaataccaaatttcgaagtttgaggctatccaaagagtagacgatataatatataaattatataaaactagggatggtaaaagttcattaaagaagttcttagatatgcatcagaatttaacattacttctgatcggaattatcaaaatacagttcagttcaaaaaaaaatgcaaaaaataaaatgattaagttacttgaatatgtccaaaataaagtaggaatttattatgaaagagaaatggttattgcgcttaaatatttcaagaatcctaaatctgttgggatatttaataaaattaataaaggtggtaatcaaaaaaaattactcgaaaaaattgaaaacacagcttgggattttatggctccgagggtaatggaatatttctctaacttgaatagtgaaggaagatattttataccatttttcttatcccacgacaaaaacttgagagagcttttaactttatttgaaattaaaggggttttacaagatattagaacgggtcagttaataccattcacaaaaatctcaagtgctgagctctttaaaaatgaaggagtagaaatagatctttctttctattctcaggaatccacaaataaaagacgattaatatatgaaaagaatattaacgaaggttttagaattctgcaagatgaattctctgagttgaatgacataatgaattaattggagcctctctatattattttacatttaatttttatgttattttatatagcatgttaacagacctaggtataaaacgctggttttgttaatccctctgtgctgtataggcaataggataaacacattattattcctttgcggggaagttatataaatgcatttgctaaaagtgaatttaaagtgattattctactaaccgtacaagaaaataatacccatatcgcagtaaactgtgacggctaaatatttctagggagataaagccttgagtttaatcaatcggatgctcttatgtcaaaggaaaatactttttatataaagactcggtaaaccaagatcataagtcccgattatcttgtatagcaggccgatttgttgtcaatattcgatttactatgaaatcacttgttggcttatagtgaacaaaacaaaaaaaccagatccactaaaatctggttccccacagctgattagaagcaacctactgttgcttctctttcaccatctttataaagagaaagaagacaatgaatacaataaaataattcaatggattcttaacgatacttatctccagcgaaatctgtaagagtatccagagaatgaagatggctagtattgaaggaatgatgattttgtacatgtcgaccaccttccatagttagtaaaagaaaggggcgcgggccctttttttttcatgattaaaagcaagatgcggcagctcccgtcattgcaccgccaacagcgccggtaattgctccgacggcacccgctcctactgttccgatgccgggtattgtgactgttcctacagcagctcctgcaagacccagtgtgccgccgccagttaccgcaccgccgccagtacctagaatacatttcccgactgattgggtgctgattgacccgcttgtttttccagcgtctttgtttacgactttgactaaaacgccatttttgattttttcatatttcagtgtaacggggtcaccatttttgtcagtagagcttttcggaagagcctgctcctcgcccgttatgttgtcttttagggttgcattgcctttagcgtcaatatgaacatctgcatgattgaacgtcatcttcagctcactgtcgttgaggttttcaactttgtatgtagcttgggaacctgcggcagccgcagcatgaggtaaaaccgggagggcaaaggcacctgctaggaataccaaggctgccagtttcactgcggttagcttcattctgctttgcataattgatcctcctcctttggttgccatactaacaaaggcattctgcttgttaaagccttaccatataaaatgataaaaaattcacccaatttcatcacattaaccaacaaggtttgtatgtttcccttcgaaagtcataggagagcagggttcatatctgatgcgaagttatcaaggaggatagaaaccgtaaagaagagctcagagaagcacctttattgcgaacaacagcttcttccgcattttccacacgacagtataaatccctttccgtcacggaaacctagtggaaaaggtttctgaaaggaggggcgtatgatgaaaagtgaaaaaattcaaaacaaaacatctttggtttggaagatggcgattgcctctgcggtttcttgggaagcggcaaaactggcgggctctgatcacccctatttagcgcctctgtctgttatcttatgtttgcagccaacgatagatcagtcgattcgtttttcttttcatcgtattgcgggaactgcgattgggatcatgctaacgtcctttcttgtcagtcacttgccaatgaatggctggatgctggggctgttcctattaggcgggacttacattgcaaagtggttacgaatagatgtaacggttctgcatcaggtagcgctcaccattttattggtctttacgtttgaacgaaactctaaagattatgcattcgaccgaatcatcgatacggtgatcggcgtcatcatcgccattctgattcacatgttcctttttccgccggactacacaaaaaaggcagcggactcttttcaaacattggcccgtcagctttccgacgcactttcagacctttccaaatgggtgcaatcagagtggggacaaggaaaagggaaccttatggaatataaaatgaaccatcttctgcaggagctgcatacggcaaaagagatgctgcaaacagcctctgacagcttaaaattcaaccccgtcagaaaaaaacataaaaacatcatttcaagctatcaaatagagatgcaaaagttgaacgccggatttgagtatctgtcaaatatagtgaaaacgttaaaagaatgggaaaaagaaggagctttatcttcaagtgataaaagggagctggggaatgatttacaagtgttaagtgaatacttttcggatcttaaaggcatacagcagggtgaaacagacaatcggaaacagaaggaacagaacgtgttattggaatctctccgctccgacatgctgtcgcacccgccgcccggtcataaggtctataaagactctttttttttagaaacgaagaaattgctgaagcgtttgtaatgttttctggaaaaagagaatacggatatacagatatgatcaggtaaaagcgggggacatgagatggatgatatacaccggattttggatgtcatcgctaattctaagaaagctaaggtactggctaccatcattcaaacagaggggtccgcttataagaaagaaggggcttcgatgttgattttagaggataaaacaagagtcggaatgttatccgccggttgtctggaagaagatctcgttgaaagggcagaacaggtctggtctgcgggagaaccgttgattgtccgctttgatatgagtgcggaagacgatttatcctggggacagggcattggctgtaatggtgttttgacggtgttgcttgagcctgtaaaaggggaattggaacggcatctgatgacagtcaagacatgcttagatgaaaaaaagtctgtgacccgaatgaagcgattcactgaaacgttagagccgaaggaagatctgtatatcgctgaagacggcagcgtgtttggaaccggggatgtgatggaacaaggccgtattcaaaaactgagacagacggagaagggaatcaaaagggatgaacatacatctgatttgttttttatccatcagatggtgccaaaaccttgtttatatgtcttcggagcaggagaagatgcgaggccgttagtttcgttggcggctcgtgcgggctttcatgtgacggtgattgactggcgtcccgccttatgtcatcacggccattttcctgaagccggccatttgataacgggagcgcctgaagaagtcatgaaaggcctgagcatgacaaaaagggattttgttgtcattatgacgcacagctttcaaaaagatcagatcattttacatacattaaaaaacgagaatgtgttttataaaggcgtattaggcccagaaggcgtacggagcggcttttaggcgggggtgagattccggaagatatacattcccctatcggacttcccatcggggcacaaggccctgaagagattgctgtaagcattgtcggcgagatgattcaaaaaatgcgaaaacaaaggtctcgcctatgaaaacagcaggcatttacctggcagccggtacaagcagacgcatgggaacggataagcgaagtttatttctcaatggcgtttccctcggaagtatggctcttaaaaatgccttgttatctgaattagatcatatttttgttattacgagaaagggagattcactgcattggctttcggattttttctttttagatcccatgtcaaataagtggagccaggcagaatgtgagcaagcgggtaagggccaaggccattctatacaatgcggtttgcaaaaagcggcagcgtacgaggctgacgccgttatcattctccttgcagatcagccgtttgtcaccgcagatatcatcaatacgttaattgattcctatcaaaaagagcgccgttattcatttatcgccgctgaaaatcagcatcttcctatgccccccattttattctcaaatcaatgtttcccggtattgcatcagttaaagggagatcagggcgcccggcatgtgatccgtgaaagtatgatcaatatgggaaaaatgatcagctttcaagaccctttgcttttttatgacgtcgatacagttgaagattatacgctgctgctgaataaattcggggagtgaatgagttggagtatatcgggaagagtgtcattcggaaagaggcccttgaaaaagtgacgggtaaagcgaaatatacggatgattttcaagaaacagggacgttgcacgcaaaaatgctgaccagtccatatgctcatgccgatattgtgtcgatggacttttcagaagcttggaagattcccggcgtgagagcgatattgggggatgaaccttttccgcttgcaggtgaagaaattaaagacagatcgccgattgcttataaaagggtcagataccatggtgagccggttgctgttgttgttgcggaaaatccgattacagctaaaagggccgcggatgccatcaaagtatcctataaacctcttcccgtcgtcaattccccccgtgaggcctttcaaaaggatgcgccgctcgttcatgaacatgcggaccgctatgagaagacaaaaggtgtattcccggttccgaagacaaatatcgcaaacgtggataaggttagaaaaggaaatattgaagacggatttagggaaagtgatgtgacagcagaattccagatttcctttaacccttctgatcacgctgcgatggagacaagatgctcgatcgctgaaattcgggcggatgaggagattatcattaccacatcctctcaagccccttttgccattaaaaaattaatgcagtggtattttggaattgaacccggaaaggttatcgtcaaaacgcctttagtaggcggggcgtacgggggaaaagcagccgttcagttagaggtgattgcctatttggcatcaaaagcagtcggaggccggcccgtcaaattgtttaatacgagagaagaggatatgatcacatctcccgttcatgtaggattggatgccattgtcaaattaggggccacaaaggatggaattttaaaggcggcggacattcagcttttatttgatggcggagcatactctgataaaggagtggacatcagccgggctgcggtggttgattgtacgggtccgtacgctatcgaccatatatcgtgtgattcatattgtatgtatacgaatcatccatatccaagtgcattcagaggctacagccatgctgaagtgttatttgcttttgagcggacgatggatgtattggcggaaaagctgaacatggacccgttagaacttcgctataaaaatgccattcgccccggtgacaccacaccgactcaagttcttctcaattcaagcacggtcggaaatgtaccgaaatgtattgaaagattgaaggaattaatgaattgggacgagggacagcgaattgaaatcgacggccggaagatacgggcgaaggggatcagctgtatttggaaaacctcaacatttgatacaaatgcaacgtccggagtgattttaacctttaatcctgatggaagcattaatttgatgtcagggatagtggagattgggacagggacaaaaacagtgttagcccaaatcttagcggaacgaatgaaaatggatataagcaaaattcacgtaaaaatgcttgtagatacacaaacaacacccgagcattggaaaaccgtggggagcagagggacgttaatggccggaaaagccgtactgaatgcagcggaggaagccattcgaaagctgaaggacgcggcatcatgtgtgttgcgagttcctgtcgaggaattggaagtggccgacggaaaggtttattttatagatcatccttctgtacatgttgacataaaagacattgcttacggatatacgtttccgaatggaaataccattggcggccaaatcattgcgagcggcaattacacattaacccggatgacgaatttagaccgggaaacgggaagaggaaagccgggacccgaatgggctgtaggtgctcaggggattgaagttgagttggataaacgggattatacgtaccgaattacaaaagcctattctgttgtggatataggaacagtattgaatgaaaaagctgcaaggggtcaagtgatggggggatgagtatgggaatcgcattcggaggaagagaaacctttgtatttgattcatatggcagagtattaaatcctcagcttagaacataccgcccccttcactatggagagcagcctgaatatatcattgaatttgttgaaaccccgcatgtgattgcgccttatggagcgcgcggcggcggggaacacggactgctggggatgccggccgcattgggaaattgcctttccgccgctttaggtgtccaattgaatcaacttcctctcattcccgaacaattatggaggacgcaagaggggtggaaagatgataccgtttgattttgattattttaaaccgaagaccattcaagaaacaatcaatctatttcactcgcttgcggccgaaaagaaaacaccaatgtattattccggcggcacggaaattatcacgttaggaaggctgaatatcatctatacggatgcggtgatagacatgaacgcgcttccgggatttcaaaccatccgcttttatgaacatgaactggtgatcggagcgggtgtgtcattaacgaaactggaggaagaaaatccatttccgctattaagtaaaacagtaagtgaaatagccgatcggacgactcgaaataagatcagcctgggcggaaacatttgcgggggcatctactaccgtgaggccgtgctgccgttgctgatttctgatagtttgctagggattgcagggagagcggggattcattaccatcctataaataaagtatttaacaaggaaatacaattgcaaaaaggtgattttttatttcatatcgttgtcgatcgagcgtatgttgacttgccatttgtcagtatcaaaagaagacagcagtggaatgtcggatatccattggtgacagtctgtgcgctgaaaaaagatgatgagatcagaatggctttcagcggcgtatgtccatttccgtttcgttctgctgaaatggaggctgtgcttaacgataaaagctattcattagaagatagagcgcgcaggtctttacagtatgtacccaaacccgttcttgatgatgcggaaggctcaagtgaataccgaatatttgtcttgcaacatacaattttagatgccttacgggaattagaaggaggtccaaatgtctgatcctattacgttgaaagtaaatggcgaggaaagacagatgacggtcagaccggctgatactttgttatttgctcttcgtcttcgtctcggattaactggtgcaaagccgggctgcttaaatggggattgcggcgcctgtacggtattaacggacggggtgccgatgaaatcttgcttaatgcttgcggcagaaggggaaggaaaggatattacgacaattgaaggactgatcaatacgccgattcaaaaggcctttattgaaaaattcgcgtttcaatgcggttattgcacaccgggttttctcatgaattgtcatgctttagtgaatactgagccgaatgcaagtgatgacacgattaaaaattggctggagtccaatatttgcagatgtaccggttatcgggagattgaagaagcggttaaatccgttttacgtatagggaaagggactcattagtccgtaaccgtaaaaaaaagagcccagagaatcatctctgaactccatattcttcacttcatataccgatactcccgcagtttctccaaaatcgccacttctttcatcagttcttcaccgacgtttgtttcttttactttcttccgctccagctctttgtcgactaatcgtttcactgttaagacgtcggttccggtgctcagcacttcggccttggagttaaagtgtttatgggcgacgagctgcataccgtatgagttgtataagagcgtgtagccggcgatgcctgttgtggattggtaggctttggagaagccgccgtcgatgacgatcatttttccgtttgccttgatcggatcttcgccttcgatttcttttaccggtgtatggccgttgatgatatggccgtgatccggattgaggccgaattccttcaggatgtttcggcaggttgcctcgtcttcacgcaaatagtaatacgggtttttcttttctttatgcgtttccttctctttaatgaaataccgctcaaaggttgtcatggcccgttttccgaagagggaggagtattcgcctgtccataagtaccacgtcatatctgtcgccagatcatcggtttcttccggatgggcaaacgcttcccgtaagaaccgttcaaatacatcgagcagctcacggcccgcataagctttatcctctatcatcatcgtttccatgctgccgttttcatcgacgggaatacagccgtgaatcaacaggttgccgttatatttcagatacaggctgcctttttcatcataaaattcatatggcggcccagcttttcggagtgctggacagaaaacagcagcttgtccatgacttctgcttcttcttctagcagctcgtcaggctgtttgggattcaccgtcgcaaagcaggtgttttccagttgatacgtttttccgttcagcgtgatttcattgcggtcataatcgatcttttccagtaacagccgttcttccatattaaagttcggccgtctcttaataatcgggctctcaagcttgaattggatcatcgcgatcgcctgatgaatttttgtgatttgtttaatctcatcttccggtctgttttcgtccgctttcgggcggaaagacgggttatcatcgtaatatttttcggcaaggttcaatagcggtctcagattgatgccgtaaacgtcttcaataatatccagattgtcatagcgggcacagatgcggataatatttgccaggcatacttttgagccggaataagcgcctatccagagaacatcatgattcccccattgaatatccactgaatgatagttgatcagttcttccatgattttatccggctgcggtccgcggtcgtaaatatcgccgaccacatgcagatggtcgaccaccaatcgctgcgtgctgtaggcaagaccggtgatcagcttatcggcctggccgagcgcaatgatctgttctatgatttcggagtagtattgttccttgttggcggcttgttctgttttgtacagcagctcttcggaaatataagcaaattgggcgggcagtgctttgcgcaatttggatcgggtgtacttggaagaacaataagaaacgagcttaatcatccgatgaatcgtttctttataccactcgtttaatgcctctttcgtatcaaagccatgtttgatcagcttcagtttgtcttccgggtaatagaccaaagccgccaattcatcaatttctctatcgtaaatgacgccgttgaaaatatcgcggatcttctcttttactcttcctgaaccgttccgcagcacgtgctggaatgcctggtactccccgtgcagatcactgacgaaatgctcggttcctttcggcaggttcagtatcgctttcagattaatgatttccgtgaccactttttcttcacaatcgtatttttgtgcgagcagatctaaatatttggtttccaatctcgtccatcccctttttatttacgagcaattgtatgataaagtgaatttaaagtatgacataatgtttaaatgattagaccttatatgatagtaccgcataacgcctttttgagacaatgaaaacggaagatacggcgcttcaggcatcaaaaattggaccgggataacgctgtgagcgtatacccctgttgacaatgcattcaacttccattaaaataaaaagttagctgatagttatttctatcggaaactcaatacgtagcaggctatgattgctgtgggtcgcactacagcaggagcggcttctggagagaccgcgggttttccgcggcgccgaagggttcacaatctcaggcaaaaggacagaagagtaccgaatatgtatttgtcatgctgttgattgtcagcggcgcaaatataatttgatattcttatgaccatgagattggagggcatccaatctctttttttattggctttttttgctcgtcgttcactagagaggtaaggaggagtcagatgtggagcagcgagagctaaagagggacttatcgaatcggcacgtgcagctgatcgctattggcggcacgatcggtaccggattgtttttagggtccggtaaggcgattcagctggcgggtccttctatcatctttgcgtattttattgtaggtattgcgctttttttcgtcatgagggcgctgggagaactgctgttatctaaagcggggtaccaatcattaacggatatagccgaggcgtatttagggccgcgtgcagcgtttgtcaccggctggacttattggttttgctggattatgacggctatggcggatgtgatcgccgtcggtgtgtatgtgaaatattggtttgatattccgcagtggattccggcacttatctgtttgctcattttattagggcttaatctgttaacggttaagatttttggagaattggagttttggttcgccttaattaaggtagtcacgattctcgcgttaattgtcatcggggtggttctgctggtgattgggttcaaaacgcataccggaacggtttcagcggcgaatctgtgggagcacggcggcttgttcccgaacggattttcaggctttttgctttcatttcagatggtgatcttcgcctatgtcggtgtggaattagtgggtgtgtcggcggcggaaacgtcaaatccgaaaaaaaatattccgtccgcgatcaataaaattccattgcggattttatttttctacgtcggggcattgatcattcttttatgtattaacccgtggatgcagctgaatgcaacggaaagtccttttgtaaagaccttcagtctggtcggcattccgttagccgcgggaatcattaattttgtcgtattaacgtctgccgcttctgcttgtaacagcgggatgttttcaacaagccggattctgtataacttaagcaaaacgaaacaggcgccggcaagttttgcgaagctgaataaaaatcatgtgccgagccgcgcgttatggatatcggttattgtgctgtcagcgggcgctcttttaagcaaattgataccggaagcggcctttggcatcgtgacaaccatcagcgcgatctgtttcatttgggtgtggggcgtgattcttgtctgtcatatcagatacaggaaaacccgtccggacttacacgcaagctcgtctttcaaggcgccgtttgcgccgtttatcaattacgccgtgctggcgctgtttgccttcattctggtgattatgctgtttgcggatgcgacgcgcccggctttgctgctgacgccgctgtggtttattggattgtttcttatctatcgggcgagagggagaaagacagattgaattacttcagacggtgtactgccatgcagtatgccgttttaatataaaaaaagcgctatcctgccgtgtaagcagggtagcgctttttacattaattccggatcaaataatcaaatgcgcctaaagcggcagttgcacctgatcccatggagataatgatttggttgtacgggccgtctgtgcagtcccctgcggcaaataggccgggaacgcttgtcgcgccgctcttatcgacgatgatttcgccgatgcggttgcgttcgacggtttcgtctaaccattctgtattaggcacgagaccgatttggacgaatacaccttggagttcaacgtgtttttcttcgcctgtttcacggtcaacgaacgtaatgccgtttacgttttggtcgcctgtgatttctttcgtttgtgcatttttgtgcacagtgacgttcggcaggctgtaaagacgtttttgcaggacttcgtctgctttcagttcaggcgcgaactccagcacagtcacgtgattgacgatacctgcaaggtcaatcgccgcttcgattccggagtttccgccgccgataacggctacgtctttgccttcaaataatggtccgtcacagtgcgggcagtatgcaacacctttgtttttgaactcttgctcaccaggtacgttgacattgcgccagcgggcacctgttgaaaggatcactgttttacttttcagtacagcgccgttttcaagttcaagttcgaagaggtcttttttctcaaggcgtttcgcgcgctgaaggttcatgacgtcaatatcataatctttcacgtgctcttcaaggcttgcagcgagcttcggtccttcagtcgctttgacgctgatgaagttttcgatgctcatggtgtcgagtacctggccgccgaagcgttcagcgacgacaccggtgcggatgcctttacgcgccgtgtagatcgccgcgcttgcgccggcaggtccgccgccgacaacaagaacgtcaaacggctctttgtcggcaaactcagacgcatctgcgccgctgcccattttcgcgagaatctcttcgatggtcatacggccgctgccgaaagattcaccgtttaagaaaacagtcggaacagccatgatgtttttgctttctacttcttctttgaatgccgcgccgtcaatcattgtatgtgtgatattcgggttgagcacactcatcatgtttaatgcttggacgacatcagggcaattgtggcacgtcaggctgatataagactcaaagcggtattctccgctgatgttcttaatctggtcaatgaccttttgatcagccttaggcgctctgccgctgacttgaagcaatgccagcactaatgatgtaaattcgtggccgagaggaacaccggcgaatgtaacgcctgtgtcttctccggtacgattaacgctgaagctcggtgttctgtttaattcagttttttcaactgaaattttagatgacatggaagccagttcgtcaacgagagccagcatgtccttagaagtgtcatcgtcaccggcgcttactttgagaacaatgtcgttctcaattagctgcatgtattgatttaattgtgctttgatatttgcatcaagtaccaatggaatgcactccttagattttacctaccaaatcaaggctaggtgtaagtgtttcgccgccttcttcccatttagccgggcagacttcacctgggttttgacgaacgtattgagctgcttttactttgtttactaggttgcttgcgtcacggccgataccgcctgcattgatttcaactgtttggataacgccatcaggatcgatgatgaatgttccgcggtcagcaagaccagtttcttcgtcaagaacgtcgaagttgcgggagatcgtttgagatgggtcaccgatcattgcgtaagtgattttgccgattttttcagagctgtcatgccagcctttgtgtacgaagtgagtatctgtagaaacagagtatacttcaacacctaattctttcagtgcagcgtattgtccttgaagatcttcaagttcagtcgggcaaacgaaagagaaatccgctgggtagaagcagaaaacgctccattgacctttcaaatcttcgtttgttacatcgatgaattcaccgtttttgaaagcttttgcttcgaatggcagtacttcttttccgattaaagacataatatcttcctcctgaaatgtgatttgaaatatattaaaaagacaaagcattcactttatctttcaataataattctaattatatatagattattaaataacatttattttttgtcaagctatatggggtattattttctgctttttttgctttagacgttaaaaaacgcctggtataagcggtttggcgctgtttgtcatgtttagcgccgggcgaaagggggattctcaattggtgaatcgaaacagtaggaatcaacccctctatatggcagtataaaccaaagggggtatgatcatgcaaataaatcacattactttgtacagttgtgcgttggaggagacgaaacacttctatgaacgggtgttaggttttcctttaattgatgagtccggggattcgtttaccatcaaggcgggagaaagtgagttggaattcaggcgcgccgattctcactctcaaccgacgtatcattttgcgtttaacattccgaataatcgttttgatgaggcgaaggcgtggataaaggataaagtcgtttttcaaacggaagatggggaggatgaggtgtatttctcccatattcaggcgcgttccttttattttaaagatccgtccaacaatctggcggaattcatcgcgagagacacatcgccgccaagcgcggaacgtttttcgattgagtccgttctgaatatcggtgaggtgaatctgacggctgccgaggtggtatcgacggggaaggagctgcagcgtctcggcattccggtgagaaagcatgcgcctcttagtgaaaacgggtttcattttatgggtgattacaatgatggggcgtttttgcttttagggccgagcggccgccgctggattttttctgatcagcatgcggagttccatccgctgtctgtcattgtgaacgggacgatccgcattgaggctgacggagaaggcggcattgacatcaggcgggcacagccgtcataaaaaagcccgggctcaaaaggcccggacttggggacattatttataaacaacccgggtgctgcacatgatgtcgtgcagcgtttttttctctccgaaggcacccatgatgaatccgatataaagaatgagcttggatatgatataggcgaaagcgcgtccgaaggcctggccgatggaaatgcgtccgccatcttcattgacgaccttaaggccgagcaatgcttttcccagggtcccctgcatctttgaggctgtgagcaggctgaaatataagatgctgatcacaatagagctcacaagaatcggaatgacgccgaacaccagaaaagagatgttaaactgattttcggtcatgaaggggtcagccgccgcaacgcctgccgcaaataaaaaagagaccataaattgaatgataaaaatcggaattcctatgatgatttgatcaatgacgtaagccagaaaccgaatccaaaatcctgccggtctttccatgtatctttttctctcccttgctttaatctggaatattatacgtaatcattccggattttgcaatggagcttaagcttctgcgagcagcctctttccccatgccaagcgtcccatgatcagcccgaaagccagaagggcaaacatgatgccgcaccacatcagctgatggattcccaaatgtgaaataaaccagccgcccgccgccgttccgatggtgatgccgaggttggaaaaggagacaaacaggctgttgccgaattcgggcgcctcctttgcttccgcagtaagccatgtctggctgacaatgagaccgccggaatgaacggcgccccatacgaagacgaggacggccatcggcgcgaaagacgtcccaaacccgtatatgagcaagtaggcggctgtataaagaagcggaaacaggatgacggtctttttcatatttttatataacaaagcaccgaagacgaaattcccggctatcataatcaccccgaaactcatcagcatgaagctgacccatgtgccgatcatatgggacacccgcccgaggtactccgcaaaatagctgtagacagaaaacatggccgcaaagagacaggtgacggcagcgatattgagccacaaagccggtttgcgaagaatgccgagctggcttctgaaagacattttttctgtgaccggcatggatggcaaaaagagaagaatgcccgtgaacgcgatgagactgatgatagcgccgaataagaaggcggcttcaagagagagacgatccgccagataagacgtgaaaggcacgccgaacgcaaagccggcggtgatgcctgaaaagactttcgttacggcttttccggattggccggcggggacaagccgggccgcggccgcaagcgctacagaaaagaacaccgggtggcataaagccggaatgatccgaaacgccagcatgacactgaaatgcgccgtatacgcgtagaccgcatttgaaacggcaaacatcagcaccgctaaaagcagaatgtatttccggtttatacctgaagcaagcaaggtcaaaaacggtcccgacacagcgacgatgaacgcgaaaatactgacaagccaccccgcttttgaagcagaaatatgaaatctgtccgccacttgcggaagaacgccgataatgcccatctcggtcgtgataatcccgaaaacccctagtgccaaaaatagaatgaagatggagctgctttttttcattgttatgtatgcctccttttatttaactacatatatagaaaaatagatatgttagaacaaaaaaatccctcctttcatggttatagctggtgctggacatagtcagcaaaggctttaatttgtttttcatttcttctgtaataggtccactttccgattcgttcggattccagcaggccggctttttgcatcgtcagcaggtagctggagatgacggactgcgcaagccctgactttgcctgaatatcaccgacgcaaattccggtgcggaaactgagtccctgatcaagataaggtctttcatcaaaatggtcttccgggtgtttaagccacgtcataatatcacttcgtgttttgttagataacgctttatgaatcaatatcggttccataacgtttattatatctatttttctggatttgtaaattcgtttttgacaaaacattctcaaattaagtaaatatcgtgctaaaatataacatattatcagattaccggtaaaaaagccgggttattgtcaggaggatattcacatgaatcaaaagaaaaaaggtgcggttgcggtgaccttgctttccgctctgatgttttgtttattgccggtcctcgtctcgctttctccgcttgcagaaacggggccgaacgcgaatcgttttaattccgcgggcatgtgggccgccgtcggtcagatccttgttatatatgcggtcccgctcattatgtatattctcggtgttcgtggcatgaaaatcatcatggctgttttttgcgggatcgggcttatcatttgcgcggctgtcttgttggtggcgttattgaccgcaatttccttagggcaggagctgtctctttattacggtcttttcgtttggtcaggcgcggctttcatcgtcaatgtggtgtggtatattgccgcgtttcgatcatccccgaagcatcagcaggctatgtgacatttgttctataaatctaccgaaaatacaaatatttcataggatgattatggtatgatgaaagcggtatagcagtttttaatagaaacgggaggaactgacattgaaaaaaaagacagcttcattgcgaatgaaaacattggcggccggcgctgcggttgctgcggctttatctgtgggggcggtttctgatctgccgggggcaaaatggctgcatccggcggctgctcaagccgcggaaacggtatttaaacaaaatcatgcggcatccggtttcttggcgggacggtatgacgcgcaggcgatgtctccgacgatgttcaactggtcaagggaaagccggtttacaagcactgccgatggcgcgttaaaatgggaaaagaatgttccggccacccctcaaaacggtgcgggagccgcggttgacggggacggcacagtatttattcaatcaaaagacgggaagctgacggcgtatcatccggacggtactgtgaaatgggtgacggaaaacctcgggacgacctatacgctgactccggtgctcggaacaaacggtgtcatttatcttccttctcacgataaaaaactgtatttcatcgacaaagaaaccggaaacattttaacatcggttccgctgagcggagcgccgagttccgatgcggctatcggctctgacggcacgctgtatgtgtcgacgctggataactatatctatgcgattaaaccgacgtcgccatcgacatggacgcaaaagtggaaatttaaaacaaacggcgtggtcggctccgctcccgtgttagcatcaaacggcactctgtatacggcaacgtacaataatatcttttacgcgatcaattccggaacgggccaagtgaaatggtcaaaaacgacgtccaacgggtttaaaggttatccggttattgatagagacggcaccgtttacgccggaaaccaggacggcaacttatacgcctatacatcaacgggtgctgtaaagtggacgttcccgttaaacggtttctccagctcttcattagcgatcgaccataacggcaatgtgtatatcggttcgggaagcggcgagctgttttccatcagcaaaaccggtaatatgaactggtctttctatacggacgggcctgtgagaacggcgccgctgattgatgcggacggcaatgtgtacttcggttctgacgataaaaacgtctatgcggttgacgctgaggggaatgaaaaatggcgctatcaaacagacagcaatgtcatttcctccccggttctggctgaagacggcacgctctacgtcggcacttatacgaaactgctcgcattcggggcaaaaaaataataaaaaagaatccgcgcacgcggattcttttttttatttagaggcttgaatgaatacgcctttttcatgagagaattctttaaaaccgtacacaccgtgatatgaaccgatcccgctcgtattgacaccgccgaacggaaggttgacgtcagtgaaatgaacgacgacatcattgacagaagcattgccggacgtcgtatgctgcagaacataatcgatcagctcctgattatggctgaatacatacaaggcaagcggcttgtcccgttcagtgatgtaatcaacggcttcactgatatcttcgtaattcataatcggcagaatcggtgcgaagatttcttcctgcatgatcttcatatcaggcgtgacgtttgtcagcacggtcggagaaatcgtgcggtcatgagcatcgaatacgccgccgaacgccgtttttgcccctttttcaatggcatcatcatacagggctttgacacggttaaagttgcggtcattgacaatctgcgtgaatttgttgcggtcaaccgtatgatcatcctccataaaacctgcattgacaatggtctgcaggagatctgtaaaggtgtcctgtacatcttccttcataaggagatagtcaggggcgatacatgtttgccccgcattgacaaatttgccgacggcgatttttttcgccgcgtccatcaaatcatagccgctgtcgatgatcgtcgggctctttccgccaagctcaagcgtgacggacgacaaatgcttcgccgctgccgtcatgacgattttaccgacattcgtgcttccggtgaagaaaatgtggtcaaacggctggtcgagcagttctgtcgcgacatcgacctcaccttcaaaaatggcgacttcttcttcgtgaaatgcctcgcgaataactgtcgcggcgatatggctcgtctccatcgtaaaatcggacagcttcacaatcgcgctgtttcccgccgcaatggcagccgcaagcggagccatcgtcagcataaacggataattccatgggccgagaattaaggtaaggccttttggctcgtacattaatacgccgtcagcgtcggggctgacggatgagccgacgcgtttcggcgccatccaggtgtcgagattgttcatattatctttaatcgccttgatcgttccctgcgtttccgctcttttcacctcatgataaggcttgcggacgtcccgtctgatcgcctcgatgatttcttcttcatgtgcggtgacggcatctaaaaagcgctgaagcttttctctgcgctgcccggctgttgaagcacgcagcgttttttgattttttttctgaagcgcaaagacgcgtttgatgtctgcttttatatgctgatccatcggttttcctcctctggttgcttttttatttcttcagggcctattataatgtgatgtgtttttgcggcaaagacagcgtaaacgcatctatacgttaccgtacaaattgccgtgatctgtctaatgaaaggagtgtctcttatgccggattctatgacaaatgacatcaaacaagcgcttttggccatgcttggagagcgggatatccgccgtgtgaccatgaaggacatcgccgaacgggcgcacgtgagccgggggacactgtacctttattacgaagataaatatgcgattttagaggatatagaggaagaaatgaaagacgggctgagcgaagcgctgtatgattcgctgaagaataaagatgtgcttcatttacagggcggatggcaaaaagtgcatccgacactgtcttttgttgaccggcaccgggtgttttttcaaacgatgatggaccgtcataaaatgccgtattttcacgttcatgcttttttaaaagatgtgttccggcatgatgtgctgctgtcaccggtcaatgcggatttctcaccgactgaacaggatatgtacattcattaccgcgcgttatacacatatgccattgtgttgtactggctgaatgaggagcccggggcatccccggaagaaatcagcggacaggtgtgggatttgatttctcaaaaacggttttactggctgtttggccgccgggtgccggaacaagaagaaaaaaagcccgccgaccgccgggtgacaaggacgaggcaggccttgcaagaagccatgatcggcttaatggcggaaacaaaagagtacgcggcgatcacgatttccgatattgcccgtcaaagcaacctccgccgtgccactttttatgaccattacgccaacaaagaagcattgctgaaaacgatcatccatcaatcatgccgggatctgatcggattattgacggtaaaaggagatcctgccgactgttccgtggaagaagcggaagccgcgctcgtccggctcttttcggcgctgtccggcggccttccgctcgttcattttctgagagagggttcaggagtgcctgacgtcatcccggaaatgttcagagcgctgcaatcgttttatcttcatcagcctctgcacattcaggcgggcaaaaagctctatgcatactatgtcgcgtccatgctcgtcggtctgattcaatatcgtcttcatgaaggaaaagaccacgcgccggatatgctggcccgggagtttctgcagtttttggatgtgaagaagtatcgggtgattttgctgtgaggatgatgaaaaagaactcggccgaaaacaggccgggttcttttttgctgttttctttgagaagtgcagatatgaaagaaaccttccatatgacgcctgattagcattctgccgccaaacatgacaaatgtcatattcggggcatgatggctgctactacaaccgcgtcgggcgccccgttatacttgaggtcataatgaaaaagaagggacatgacattcatgatcaatcacgccgcaactcaaaaacaagcgtctttaaaaaagcaggttgccgcattttccggcgccgatacaaagcatagtatcattcagcttttcaacacgtttgtgccgttttttgccctttggtttcttgcttacttcagcctcaatgtctcctatcttctgaccctcgcctgtactgttatagcagcgggatttttgacaagaatctttattattttccacgactgctgccaccaatcctttttcaaacaaaagaagctgaaccggctgttcgggtttatttcaggtgtgctgacactgtttccgttccttcaatggcagcgaagccactccattcatcatgcgacaagcagcaacttagataaacggggcaccggcgatatttggatgatgaccgtcaaggaatataacgaagcgtcagcctggacaaaaatacgctacagactttatcgcaatccgtttattatgtttattctcggcccgatttacgtatttctgattaaaaaccgtttcaatgtaaaaggcgcccgccgcaaggagcgctggaacacctatttcacgaacgcggcgattgtcttattggctgctgcgacgtgcttgcttctcggctgggaaaactttttgcttgttcagggtccgattttccttatttcggggtcaatcggcgtctggctcttttatgttcagcacacgtttgaggattcttattttgaagccgatgagcattgggattatgtgcaggccgcggtagaaggaagctccttttacaagctgccgaagcttttgcaatggctgacgggcaatatcggctatcatcatgtccaccacttaagtccgaaggtgccgaactacaagctggaagccgctcatgagggacacgagcctttaaaaaacgtaccgaccattacgcttaaaacaagtcttgaatccatgaaattccgtctgtgggatgaggacgaaaagcagtttgtcaccttccgggaggcgcggaaaacatcggcgccccatccggtgccgaaagaacctttaaagaaaaatgcctgatacggcgcacggctctttctcttatcagaaagagccttctcttcatgcgtgagggtgcaatgaaggcggtgttttgataaagtgatggtagacacaagcagcagaaggtggaacaaagatgaagaagtattttaaatttcaaaaactgaacgggatttctccttatatatggacgatttttttcatcctgcctttttattttatttttaaaagctcttctaccttcgtcatcgtggccggcatcattttcacgctcgttttctttggcgcataccgctttgcatttgttgcaaaaggctggccgctttacttatgggcgcttcttctgatcggcatttcgaccggctcagccatgctgttcagttatatttatttcgccttctttattgcctacttcatcggccatatccgagacaaagttccattttacatcttatattacattcatatcatcagtgcggcggttgccgtcaacttcagccttgttctgaaaaaagaatggtttttgacacaaattccgtttatcgtcattacactgatcagtgccatcctgcttccgctcagcattcgaagcagaaaggcacgggagcgccttgaggagaaattagaatatgcaaatgagcgaattgccgatcttgtgaagctggaagaaaggcagcgcatcgcccgggaccttcacgatacacttggacaaaagctctccttaatcggactgaaaagcgaccttgcccgaaagctgatatataaggaccctgaacaggcccgcgctgagctgaaaagcgtgcagcagacggcccgcacttccttaaatgaggtcagacaaatcgtctcatcgatgaaaggcatccgattgaaggatgagctcggcaatgttcggcaaattcttgaagcggcaggaattgaatttgtgtatgaagaaaaagaagcgcccaaacatatctctttgctgaacgaaaacatcgtcagcatgtgcattaaagaagccgtcaccaatgtcgtgaaacacagcggcgccaaagtatgccgcatcaccattcagcagctttggaaagaggttgtcattacggtagaagatgacggaagctttcaatgcagagaagaccgctttttttcaaaggggcacggcctgcttggaatgagggaacgtcttgaattcgcaaacggcagtttagccatcgatacagccgccggaacaaagctgaccatgagaatcccgaatgattcaaaatcaaaagaaaaggatggtagcagatgatcaacatcttcattgccgaggatcagcaaatgctgctcggcgcactcggttcgctgttgaatttagaagaggatatgacggttgtcggcaaaggcacaagcggccaggatgccatcgatttcgtggaaaaacatgcgcccgacatctgtctgatggatatcgaaatgcccgggaaatcaggtcttgaagcggcagaagaactcaaggacagcggtgtgaaaatcatcattttgacgacctttgcccgctccggctattttcagcgggcgctaaaagcaggcgtcagcgggtacatgctcaaggacagcccgagcgatgagctcgtcagcgccatccgcagcgtcatgaaagggagacgcgtctatgcacctgaattaatggaggacatttatagtgaagaaaacccgctgaccgaacgggaaaaagaggtgctcgagcttgtcgcagacggaaaaaacacgaaagaaatcgcaaacgccctcagcatcaaaagcggcacagtccgcaattacgtttcgatgattctggataaactagaagtgaaaaatcgaattgaagccattacccgatcaaaggaaaagggctggtttaagtaacccgccctcagcttgttcagccagtgttttttttacactggctttttttattatctatcgtcactccgtctcttccttccacttcttatcaatcagcattttccccggccaagtgtatgccatgatgccgccgtctgcggtgatgtcttctcccgtgacgtaagagctgtcgtctgaagcgaggaagagcgcgacagccgccatttcttccggttttccgagccggccgagcggcgtgatccatttgttggcttcacggaacgcctcgcccatttcgtcttctttcgtgcctgccaatttatcaatgagcggcgtttcaattgtacccggcgataaggaattgacgcggattccgcttctggcgtaatcaatggccatcgctctcgtcaggttcgtgattccgccttttgcggcgttatagccggaacggtcaaggtctgcggcccggccggacatggaggaggtgttgatgatggagcctcctttttcgagcatgagcggaatcaggtatttgctgcacagaaatgtgccgcgcagatcgacggcgatgatccggtcaaacaggtcgaccgggtattcatggacattgccgccctcttggtcaacaccggcattgttaaacagaatatcaattgttccgtacttttgctgaatgccgtctgcaaaagactttacgttttcttcatctgatacatcaaggtgaaaggcttctgcttctccgccgttttttctgatggcgctgacggtttcattcagttcgctttcattgatgtcaccgcagatcacgcgggcgccttcatcggcgaaaacccgtgccgtcgcttgtccgatgcctgtcgcggcccctgtgatgattgcggttttgtctgttaatcttcccatattgcgattcctcctttttctatacctgttcccgctgaatagggggataaacatacggaggtttgtttctaattacctattaaatatgttaatattatgtatatacatcattgggaggtttacatattttgaagatacagcataagaaggagatagcgttttattgttatgccattgttcctatgggatttgtgatctacaccgttatctctattctgtttcaggacatcacgtttcctctcactgtaagaaatgttctgcatgagtctttgcgaaacttgggatctcttatcttatttagtttgtttttctacccgtcatacatatggatgaagaaggaattcggccgccggaaagaagcagagaggagaggatgatcaacattctctcttttttattgataaaatgggtgaaatgaatccattaacatgttaaatttacaatatatgcatctgctaatcctagttgacaattgtcactgtatatgataaatagatgctgaaaagattttacataacatcaaagcataattaaaggagagatctgaagtgcggaaaaaaaagtttaaagcagaatccaagcgattgctggacatgatgattaactccatttacacgcagaaggaaatttttctccgcgagttaatttccaacgcgagcgatgcgattgacaaaatctattacaaggcgttaaccgatgattcattaacgtttgatcaagacaattactatataaaagtgacggcggacaaagaagcgagaacgcttaccgtcacagataccggtatcgggatgacaaaagacgagcttgaacagaatctcggcacgattgcgaaaagcggttcactcgctttcaagcaagaaaatgactcgaaagacggccatgacattatcggccagttcggcgtcgggttttatgcggcgtttatggtggctgataaagtcacggtgaaaagtaaggcgctcggcagtgacgaggcgtatgtatgggagtcggaaggggccgccggctacacgatcgcgccgtgtgacaaggaaaccgtcggtacggaaatcaccctgaaaataaaagaaaacacagaagatgaaagctatgatgagtttttagaaaactaccgcatcaaagcgatcgtgaaaaagtactctgattttatccgctacccgatcaaaatggaagagacggtcaacaagccgaaagagggcagcgagaacgaatttgaagaagttcaggaagaacagacggtcaacagcatggttccgatctggagaaaaaacaaaagcgagctgacggatgaggattacgaggctttttacgccgagaagcattacggttttgataaaccgctgacccacgtgcatatcagcgtcgatggagcggtgcgctacaattcgattttgtttattccggaaaacatgccgtttgactattatacgaaggaattcgaaaaaggattggagctgtattccaacggcgtgctgatcatgaacaaatgcgccgacctgcttccggatcatttcagctttgtaaaaggcatggtggattctgaggatctgtcgctgaacatttccagagagatgctgcagcacgaccgccagctgaagctgattgcgaaaaacatcaataaaaaaatcaaagccgagctgaagagcttgctgaagaacaaaagggaaaaatacgaatctttctatgaatctttcggcagacagctgaaattcggcgtctataatgatttcggcgcgaataaagacgtcttaaaagatctgcttctcttctattcatctaaggagaaaaagctcgtcactctggacgaatatgtgtccagaatgcctgaggatcaaaaatatatctattacgcgtccggcgattcatatgagcggattgaaaagctgccgcaaactgaaatggtggcggacaaaggctacgaaattttatatttcacggaagatattgatgaattcgcgatcaaaatgctgacaagctacgaggaaaaagagttcaaatccgtctcaagcgccgacttaggcatcgacagtgacgaagatgataagcagactgaagccgaagaaaacgaatataaagacctgttcgaaagcatgaaagagattcttgcggataaagtcaagaatgtcagagcctcaaaacgcttaaaatctcatccggtctgctttgcgacagacggcgaagtgacgatcgaaatggagaaagtgttaaacgccatgcctgacagccagcaggtcaaagcggaaaaagtgctggaaatcaacccgaatcacgaagtgtttgagacgttaaagaacgcgcacggacaagatcgggaaaagcttgctttatacacaaacctgctgtacaatcaggcgcttctgattgaagggctgccgatccatgatccggtcgagtttacgaatgatatctgcaaagtcatggtatgacgccaaaaaggaatcgcccagcggggcgattccttttttgattacagtgtgcgctgtttaagaatttgattttgtttgctgcgcttctttaaggagaaccgttttttcaagtgcgtttcgatttcttctaaacttttgcccttcgtttcaggaacgatgtaagcggcaaagaagaaggatgtaaggcagatgactgagaatattccgaacacccagccgatgcccattgcgctcagcataagcggaaataccagcgaaacgatcaggttggttgccgacagaatcaatgtcgtaaatccggttgcggctccgcgtgcgtttgacgggaacagctccggcatcagaacccatacgacgggaccccatgtcgcctgataaaagacgatatagattccgagaaacagcacggtcagccaagctgttgaagctgacaggccggccagaaggagaatggctgatagtgacgccaggctcaaggtaatgccgacacttccccacatcagcagttttttccggccgatccggtcaattaagatcatggcggtgatacacatgatgacgtttaagacaccgatgcccatcgtgccgagaacggacgccgaagtgccgagtccggcctttgtaaagatggtcggcgcatagtaaatcaccgtgttgataccgaccgcctgctggaagatggcgaggccgatcccgatcagcagcataggacggatccattttgctttcagcaagccgagcgtagattcttttttctcggcttctccttgtttcatttccgccaattcaacggcgatatcctctttgtcgtgagtcatttccatgacttgtctggcttcctgctcacggccgcgtttgacgagccatctcggagattccggcataaacgcgattccgattaataaaagcgccgccggtactgccgcgagaccgaccatccagcgccaagcttcaaacggggtgaatatgtaattcacaatatatgcgagtaaaattccggttacaatcattaagttattcaatgtgccgagcgttccgcgtatttttgtcggcgccatctcagatagataaacgggaaccagcgccgttgagcctccgacggctaacccgagtatgacacgggagataatcagcatggtgacggtttgcgaagccgcacaggcaagcgcgccgataataaaaatgagtgaaaggacgaaaaccacttttctccggccccatcggtcagagcatgtcccgcttaaggcggacccgaaaatcgcaccgagcagcagcatgctgacgaccaatccctcggtcagcgtgtttaaaggaatatcattgttaataaataacaaagcccctgaaatcacaccggtgtcatagccgtaaagcagcccgcccaatgctccgaaaaagtaaatcaggtattttttggtgtttttcttcacagatgatcctcctcatcttttggaacgcataatagtttatttagataactatttcattccccgaagagaaaaatataaacataaaaaaacacgccctttcaaaaaggcgtgttatttttcttaggaaaacagcttgtcaataaacgcgatttcttcagcagatagcgtaatggaggctgctttcatgttgtcttttaattgatccgcgcgtttggcgcccggaatcaggatatcgatttcaggtctcgccaagtaccaggcaagcacgatatgcgccgtatcggcattgtgcttttcagcaatcggtttgagctggttgacttttttgatgttttctttaaactgctccccttggaaatgcgcctgatcattgcgcaggtcgccttccgggaaggttgtgttctcgtcgtatttgccggccagcagtccggatacgagcgggaagtacggaatgaatgagatgccgtgttctgtcgtataagggaagaaagtcttttccgcctcacggttcagcaggttgtattctccttgaatcacgtcgactaagccgtctttattagcttctttcagctgctccaaagagaaattggatacgccgatggaacggatttttccttcttttttcagctcattcaatgcttgaacggcttcgtccttcggtgtatgctcatccgggaaatggatgtagaataaatcgatgtaatccgtctgcagccgtttcaggctgtcttcaaccgattgtttcaaaaaggccggtgagttgtcgaaaacaaagtcattgccttcttttctatgagcggcttttgtggcgatgaagacatcctcgcggttatattctttcagcacctcgccgatcaattcttcagaacggcccacaccgtaaatataggcggtatctaacatggtaacgccgcttttaatcgcttcccggaccaattcttttcccgtttcttcattcagattcggatagagattgtgtccgccgaccgcatttgttcccaaaccgatcggaaatacctttaggtcagttttgccgattgttactttgctcatgttttcgccccctgaaaaaattggatatcatagcgcctgccgggaaaatacggcagcgttctctattaactataacgctatgccaagtgaatgtcgatttggtgctcttggcaatacttcgtatattcctcatcgagctgctgagaagtgacgatgctgtgaagccggtcaaaaggcgcgtatgtcaaaagcgtggatttgccgaatttggaatgatccgcgagcagatacacttcgttcgccttttcggaaattttctttttcacctcgtattccagtaagtcggaattcgtcaggccgtgggtgatcgttgtcccggtagcggacatgaacgccttgttaatgttgtatttattgagtgtgcccggatcatcaatgccgacaaacgaccttgtcttccgtttgtagttattgccgatgatgatcaggtcgatatttttcatggatgaagcggcgttaataatatcaaggctgttcgtcaacaccgttacattcttatccgggtcaagcgtctccagcatcgatttggtcgtcgtgccggaatcaataaatacaagatcgtgatcctcgataaaccgcgacgcatagcgggcgattttgattttttcatcctgatgttgaatggtgcggttctcaaaagggacgagcacagatttttctgctgacgtcacgccgccgtacacctttttgatcacccctttttccgcaagcttattaatatcgcgtctgaccgtgtttttagagacgttgaatacctcgcacagctcatccagcgaagtggctccgtgtttgagaatgtattcttccatctcctgaatccgcatcagtttcataaaaaaactccttctagaattcttaaagtaattaaaatatataataaacaccaagagttaatcaatagttacttaacaaatgataaaaaagagggttcccaccgtacgattcgacacggttctccaagttcctgttttcccgcttaaaaaaagtatgataaaaataatgaaaaaattttgattttttagattgacttgaaggtgtgttgggcttacaatgtaaccaagaaatgaccaaaatataacctgtaaaatcaaaagtgaaagatgtaaccgtttgctttatccggcacatgaccaacttttacatgaaaagattgggagtcaccatcattttagcatttgtaagcgtttaattcatgtcttttatatgtaaaagatgaatatattcatccgttattatccagctgaacaggatgtttactatttaaggaggcaatgagaatggcagagatcagaaaactgaaaaactacatcaatggtgaatgggttgaaagtaagacagatcaatatgaagacgttgtcaatccggctacaaaagaagtgatgtgccaggttccgatttctacgcgggaggatgtggaatacgccgtccgctcagcgtcagaagcgtttaaaacatggtcgaagacggcagtgccgcgccgtgcgagaattctatttaactatcagcagcttctccagcagaacaaagaagagcttgcccgtctgatcactttggaaaacggtaaaaacacgacagaagcactcggtgaagtgggacgcggaattgaaaacgtcgaattcgcagcaggcgcgccgtcactcatgatgggcgattcacttgcctctatcgccacagatgtagaggcggcgaattaccgctatccgatcggggtggtcggcggcatcgcaccgttcaacttcccgatgatggtcccgtgctggatgtttccgatggcgatttcgttaggaaacactttcattctgaagccttctgagcgcacgccgctgttaacggaaaaactggcagagctgtttgaacaggccggtctgccgaagggcgtcttcaatgtcgtgcacggcgcgcatgacgtcgtaaacggcattcttgagcatccggagattaaagccatctcattcgtcggttcaaaacctgtcggcgagtatgttttcaaaaaaggcagcgaacatttgaaacgcgtgcaggcgttaacgggcgcgaaaaaccatacgatcgtgttaaatgacgcccaccttgaagatacggtcacaaacattatcggcgcggcattcggttcggcaggagagcgctgcatggcatgcgcggttgtgacggttgaagagggaatcgccgatgagtttatggcgaaattacaggaaaaggccgcagacatcaagatcggaaacggactggatgacggcgtgttcttgggcccggtcatccgcgaggacaacaaaaaccgcacgcacagctatattgaaaaaggcatcgaagaaggagcgaaactgctttgtgacggccgtgaacatgtaacggaagacggctatttcgtcggaccgacgatttttgacaacgtgacgacggatatgacgatctggaaagatgagatctttgcgcctgttctgtcggtcatgcgtgtgaaaaatttaaaagaagcggttgacatcgccaaccagtctgaatttgcgaacggcgcctgcctgttcacgtcaaatgcgaacgcgatccgctacttccgtgagaatattgacgcgggaatgctcgggatcaaccttggcgtcccggcgccgatggcattcttcccgttctcgggctggaagtcttctttcttcggcacattgcacgcaaacggaaaagacagcgtcgacttctatacacgtaaaaaagtcgtgacggcacgatacccgtctcctgacttcaattgatcagacagccggcccggacggctttgtgattccgtccgggttttcttttaccatccattaaggaggaataaacatgagtcatttgctgcgcaaaccgcaggccgatgaaatttctcaaggcgtgaccatcatacatgacgtcacttcagccaattcagacctcaaatacgtcggatttaaagtcgttgatctcgctcccggctcaacctatacagaagatttgaaaaagacggagtgctgcatcgttgcggtaactggaaaagttaccgtcactgattatgatcagacatttgaaagcatcggcacccgtgaaagcgtatttgatagaaaaccgacggacagcgtttatgtgtccaatgaccgctcttttggaatcacagccgtcagcggggcgagggtcgcgctgtgctactctccgtccgaacaccagcttccgacaaagctgattaaagcggaagacaacggtgtggaacatcgcggcaagctggcaaacaaacgaaccgttcataacattctccccgattcagatccatcggcaaacagccttctcgttgttgaagtttacacggacagcggcaactggtcgagctacccgcctcataaacatgaccaagacaatctgccggctgaatcatttttagaagaaacctattaccatgaaacggacccgccgcagggatttgtcttccagcgtgtgtacacggacgaccgctcgattgacgagacgatgaccgcagaaaatgaaaacgttgtcatcgtgccggcgggctatcacccggttggtgttccggacgggtatacctcttactacatgaatgtaatggcgggaccgacacgaaaatggaagtttcataatgatccggcccatgaatggattctggaacgctgacaagtgaggagtggcagataacgatgaaatatacgtttaatgaagaaaaagagtttgatattgtcgcgatcggacgcgcgtgtattgatttgaacgcggcggaatacaaccggccgatggaagaaacgatgacgttttctaaatatgtcggcggctccccggcaaatattgcgatcggcagcgctaagctcggattaaaagccggttttatcggcaaaatcccggatgaccagcacggcagatttatcgtttcttatatgcaggaaaagggcgtcgatacgtcacaaatgaccgttgacagagaaggacgcaaagccgggctcgcttttacggaaattctcagtcctgaagagtgcagcattctgatgtaccgggatgacgtggcggatttgtatctagagccgtccgaagtcaatgaaggctacatcgcaaacgcgaaaatgctgctcgtatcaggtacggcgcttgcgaaaagcccgtcgcgcgaagccgtcttaaaagcggtgcaaatcgcaaaaaaacatgacgtaaaagtcgtgtttgagctcgactaccgtccgtatacatggcaatcggcagaagaaacagccgtgtactacacgctggcggcggaacaatccgatatcgtcatcggtacgcgtgacgaatttgacgtaatggaaaaccgcagcggcggaaataacgatgaaaccgtccgccatttgtttgcgcactccgccgaccttgtcgtcattaagcacggcgttgacggatcatacgcatacagcagatcgggagaagttttccgggcgcacgcctataaaacaaaggtgctgaagaccttcggagcgggtgattcctatgcgtcagctttcatctacggactggtcagcggccgggatattgaaacgtcgttaaaatacgggagcgcttccgcttccatcgtcgtcagcaaacacagctcctcagaagcaatgccggctgccggtgaaatcatcgaactgattgaagcgcagcacagtcttaacggtaaatagaacgtataaaaggtgggatcgtttgtgggtaagacaattcgcttaacgacagcacaagcgctgattcaattcttgaaccggcagtacattcatgttgacggaaaagaagagccgttcgttgagggcatcttcacgattttcggccatggaaatgtgttggggatcgggcaggcgctcgagcaggacgccgggcacctgaaagtctatcaaggcaaaaacgaacaaggcatggcgcatgccgcgatggcatacagcaagcagatgctgagaagaaaaatttacgcggtatcgacatcggtcggtccgggtgccgctaacttgacggctgccgcgggtacggcgctggccaatcatatcccggtgctgctgcttccggccgatacctttgcgacgaggcagcctgacccggtgcttcagcaggtggagcaggaatacagcgccgccgtcacgacaaacgatgcgttaaagcccgtgtcccgctattgggaccgcatcacccgccccgagcagctgatgagcagcttaatccgggcatttgaagtgatgacagatccggcaaaagcgggcccggcgaccatctgcatttctcaggatgtagagggagaagcatttgattttgatgaaagcttctttgaaaaacgtgttcattacattgatcggatgcagccgagcgagcgtgagctgaaaggcgccgcggagagaattaaggagagcagccgtcccgtcattttagtgggcggcggcgcgaagtactccggcgcgcgtgaggaattaatcgcgctttctgaaacatacggcattccgcttgtcgaaacgcaggccggcaagtcaacggttgaagccgattttgccaacaatctgggcggcatgggcatcacgggcacacttgccgcaaacaaagccgcccgccaggctgatctgatcatcggtgtcggcacacggtacacggactttgcgacatcctcgaaaacggcgtttgattttgacaaagcaaaatttttgaatatcaatgtcagccgcatgcaggcatacaaacttgacgcgtttcaggtcgtagccgatgcgaaagtgacgctcggcaggctgcacggcttattagacggatataaaagtgcattcggcacggcgattaaaggctggaaagatgaatggctggctgaacgggaccggctcggcaaggtcacttttacacgtgacgcgttcaagccggaaattaaaaaccatttctcacaggacgtgttaaacgagtatgccgacgcgctcgagactgagctgccgcaaacaacggcgctgttgaccatcaacgacacgattcctgaagacagcgtcgtcatcagttcggcgggatctcttccgggcgatctgcagcggctgtggcattccaacgtcccgaatacgtaccatctggagtacggctattcctgcatgggatatgaagtatcgggcacgctcggcctcaagctggctcatcccgacaaagaagtctattcactcgtcggcgacggaagctttctgatgctgcactcagagctgattaccgcgcttcaatataacaaaaaaatcaatgtcctgctctttgacaactccgggttcggctgtatcaacaacctgcagatggatcacgggagcggcagttatttctgcgagttccgcacagaggacaatcagattttaaacgttgattacgcgaaggtggcagagggctacggcgctaaaacatacagagccaatacggttgaagaactgaaagcggcgcttgaagatgcgaaaacgcaagaggtatccactttaattgaaatgaaggttctgccgaaaacgatgacggacggctatgacagctggtggcatgtcggcgtggcggaagtgtctgagcaggaaagcgttcagcgggcatacgaagcgaaagagatgaagctgaagtctgcgaagcagtactagaggggaggcatcacgatgggcaaacaaaatattttgtggggcatcgctcccattgggtggcgcaatgacgatatgccggagatcggagccgggaatacgctgcagcatttgttaagcgatattgttgtcgccggttttcaaggtacggaagtgggagggtttttccctgaaccctccgtcctcaataaggagctggctctccggaacttgcggattgcggggaaatggttcagcagctttatcattcaagacggtattgaaaaaacggctgaacaatttacagaacactgtgattatttgcagaaagtcggagcggatgccgccatcgtttctgaacagacgtacagtgtccagggcttggatattgatgtatttaagaaaaaaccgcacttctcaaatgaagaatgggatacactgtgccaaggcttgaaccgtctcgggaaaatcgctgacgaatacgggctggagctcacgtttcatcatcatctcggcacaggcgtccagacggcggaagaagttgaccggctgatggatggaacggacccgcggtatgtccatttactttatgataccggccatgcctatatctcagacggagactatatgacgattctcaacaagcatatggatcggatcagacacgttcatttcaaggacgcgcggtttgacattatggagcggtgcagacaggaaggcaagtcattcaggcagtcgtttttacagggcatttttacggtgcccggagacggatgcatcgattttaccgaagtgtaccaaacgctcgtccgtcatgattattcaggctggatcgtcattgaagccgaacaagacccggcagtcgccaatccgcttgagtacgcgctgattgcgagaaagtacatcgacagtgaactgcttgatcctgcaaattagagggggacttatatgaatagtgccaaggcggaatcagctttcagcaaacggaccatcgccgcagcattagcaaattacattgatgcaggttccatcgtggcaggatcagcgggtttatctatgtgggtcagctacttgaagctgtccgacagtcagatcggattgctcggcgccttcagcgcaaacgcgatatcagcggccatcggagcgctgctcggcgggtatttggctgataaggtcggccgaaaagctgtatacacaaacagtatgctcgtctacgctttaggaatttgtttggttttgtttggattcaactttcccatgctgttatgcggatacatgattatcgggatttctgtaggcgcggatattacggcttcatggaccattatcgcggaaaacgcccccgagaaaaaccgggcgaggcattgcggagtggcgcaggtggcgtgggccgccggagccgttgtggttctgctgttatccgttttggtcggtgacctcgggcttttaggaaataaaattgtctttgcgcatctattggtgatcgccctgatcacatatgtgataagaaagcgtttacctgagtcggatgcctggaaaaacagtgaagagcggcctgccgccgtgaaaaaaacatcttattttgacttgcttcagccgaaatttttcaagaacattttgtttttaatgggtgtgtttctcgtatggaatctcgccgcgggcgtcatgggattcttcatgccgtacatctaccagcaggtcggcggcgtatccgcaaatacggccaacattctgcagatggccctgtttatcttcaccgggctcggcgtcgcctgtatcttcatgccttttgcagatcaatatcggaaaacggtgttcggaatctgcgcctttatggctgttgtcggctggtcgctgtttttgctgccgtttcagggactcccgatgctgcttttgtttgttttagcgatcggcatcaataacggagccggccagcaggcgaactaccagctgtgggcaagcgagctgttcccgacagaacacagagcgtcagcacaagggctcatgttctttctcgtccgtatttcaatcggcatttggagtttatttgtgccggtcatcatgtcacaattcggcatcggttttatggccggtattctgctcatatgtgtgacggccagtatgatcatcgggcttgtcttcgcaccgaatacgtccggcaagtcgcttgaacagatacaggaggaactgtacggtgctcctcaggacggcagagagaaaagaaagacgagaaccattatttgattatcagaaggagtggcgatcaatgaatttacgtataggtgttatcggaaccggtgctatcggaaaagagcacatcaaccgcatcacaaataagctgtcgggcgcggaaattaccgctgtcacagatgtgaatcaggaggccgcgcagcagaccgttcagcatttcaatttgaacgcctcggtttatcctgatgacgacagccttctcgctgctgaaaatgtggatgccgtcttagtgacaagctggggcccggctcacgaatccagcgtgttgaaagcgattcagcacggcaagcacgtgttttgtgaaaagccgcttgcgacaacggcagaaggctgtatgcgcattgtcgaggaagaaatgaagacgggaaaacgattggtgcaggtaggtttcatgcgcagatatgacagcggttacgttcagctgaaagaagcgatcgacaaccgtgcggtcggcgagccgctgatgattcactgtgcgcaccgcaacccgacagtcgcatcgaattattcaacggacatggccgtcgtcgatacgctcgttcatgaaattgatgtcctccactggcttgtcaatgacgactatgaatccgtacaagtcatctatccgaagaaatcaaaaaatgcgctgccgcatctgaaagatccgcagatggtcatcatcgaaacaaaaggcggcatcgtcatcaatgcagaaatctatgtgaactgtaaatacggctatgacattcaatgtgaaatcgtcggggaagacggcgtcattaagcttccggaaccgtcaagcatcagcttgagaaaagaaggaaaattcagcaccgatattctgatggactggcagcgccgatttgcggctgcgtatgatgtggaaattcaggacttcattgattcgatccggaagaaaggcgaagtcagcggtccgacggcatgggacggttatattgccgcggtgacaacagacgcgtgcgtaaaagctcaggaatccggacagaaagagccagtggcgcttcaagagaaaccggcattctatcaatcatttacgactgtgaacaaataatagatcgggagtgaaaaaatgaaactggccttagatccatccatgtaccgcgatgatttaacattagaggaaatggtctataaaacggcggaactcggatacgaatatatcgaactgtccccgcgcgaggatttttgtcctttctataaatatccgaaagtcgattcagcaaaaatcaaacaattgaagcgccttttaaaggatacaggtgtgaagctgtcctcccttcttccgctttaccactgggcgggtcctgatgaagaccgccgccaggccgccgtgcgcaactggaaacgggcgatcgaaattgcggttgaacttgaagtggatttgatgaacagtgaattcagcggttcaaagtatgatccgttgacaagtgaagaaaaattcatcaaatccatggatgagctgctgcccgtctttgaaaaagaaggcgttaaactcaatcttcaagcccatccatacgattttatcgaaacgcacaaaggtgcgatggatatgatccgcgcgctcgataaggattggatcaatcttgtctactcgactgcgcatacgttcttctatgatgacggcaaaggcgatatcgaaaccatgtttgatgaagccggcgaccgcctcacacatgttttatttgcagatacttttaatcataaagcggcgcacggcctgcgttacatcgtcaatccgcctgatgcgaaagtaacggttcaccagcatctggacatcgggcaaggcgaggtcgattttgagacgattttcagaaagatgagagagatgaaattcgacggaattgcgacgaacgccgtgtttgcttgggtcggcgaaagagcggatgaatcaagccggaccacgcttaagaaattaaaggaagaactgggtatggcataagctgagtatggagttcggcggagcggggcaaaaaagcccttcagccggactcccttcatatcgaaaacgcggatgggagaggctgacatgaaactttgctttaatgaagcgactacgctggagaattcaaacctgaaacaggatttagaactgtgcgaaaagcacggctatgattatattgaaatccgcacaatggataagctgccggaatacttaaaagaccattcactggccgatctggcggaatattttcatacccatcatattaaaccgcttgccctgaacgccctggttttcttcaacaatcgtgatgagaagggttatagggagatcatttcggaattcaaaaaaatgatggaaacctgcaggacgctcggcgtgaaatatgtggtggccgtgccgcttgtgacagagcggaaaatcttgaaagaagaaatcaaaaagagcagcatagaggtgctgactgagctttcggacatcgcggagccgtacggcgtaaacattgcccttgaatttgtcggccacccgcaatgcacggtcaatacatttgaacaggcgtatgacatcgtgaacgctgtcggccgcgataatgtcggactggtgtttgacagcttccatttccacgcgatgggctccaatattgagagcttgaagcaggcggacggaaagaaaattttcatctatcatatcgacgatacagaagactttccgatcggctttttaacggatgaagaccgcgtctggcctgggcagggtgcgattgacttagacgcccatctgtcagcgttaaaagaaatcggattcaatgatgttgtctccgtagagctgttcagacctgaatattataagctgactgcggaggaaacgatcaaaacggcaaaggaaacaacggaagccgtcgtatcaaaatacttcatgaaggaggcgtgaacatggcttttgtcaccatgaaacatcttcttgcagaagcgaaacgggagcattatgcagtcggccaatttaatatcaacggcctccaatggacgaaggcgattctgcaagcggcgcaaaaggagcaatcgccggtcatcgccgcggcttccgatcgtctggtcggctatttaggcggatttaaaacgatttccgccatggtcggcgcgttaatggaagaaatggcgattaccgttcccgtcgtgctccatcttgatcacggaagcagtgcggaacgctgcagacaggccattgacgccggattcagctcagtgatgattgacggctcccatcagccgattgacgagaatatcgcgatgacaaaagaagtcaccgattatgccgcaaagcacggcgtctcagtagaagccgaagtcggcacggtcggcggcatggaagacggacttgtcggcggggtctgttatgccgatatcatggaatgtgaacggatcgtgaaagaaaccaatatcgacgcgctggcggccgccctcggctccgtccacggcaaatatcagggcgagccgaatctcggatttaaagaaatggcggctatctcccgcatgactgatattcccctcgttctccacggagcatccgggattcctcaggatcagatcaaaaaagccatcacgctcggccacgcgaaaatcaatatcaacacggaatgtatggtagcctggacagacgaaacacgccgcatgtttcaggaaaacggcgatctgtacgaaccgcgcggctacatgacacccggccttgaagccgtggaagagacggtgcgaagcaaaatgagagagttcggatcagccggtaaagccgtaaaacagcagatcggctgatgaaaacggaaaccgccaagatggcggtttttttgtgcggtgttgcgtccgtacgcccgaaacgattatgatgatggcagcagtgtaagaaacgggagtggttcagtttgaataaaatcatgattgtggaagatagtgaagacattcgcggactattgcagaattaccttgaaaaatacggatatcaaaccgtggccgccgcggatttcacggctgttcttgatgtctttttgcgggaaaagcctgatgtggtgctgcttgatatcaacctgccgtcttatgacggctattattggtgccgccagatccgccagcattctacaagcccgatcattttcatctcagccagaagcggggaaatggatcaggtgatggcgattgaaaacggcggagatgattatatcgaaaaaccgttttcttatgatattgtgctggcgaaaatcaaaagccagatccgcagggcatacggagagtacgccgccaagcagggagagaaagtggttgaatatgccggtgtgcagctctttgtggaacggtttgaactgcgctttcaggacgaaaaaagcgagctttctaaaaaagaaagcaagcttttggaagtgctgctggagcggggagaaaaggtgacgggaagagaccggctcatggaaaaaacgtgggacaccgacattttcgtcgatgataatacgcttaacgtgtatatcacgcggctcagaaaaaaactgcgggagctgaacgcgcctgtttccattgaatcggtgcggggcgaaggctaccagctgagggcgctgtcatgaagctgtttctccggtctcatgccgtgctgattctgctttttctccttcaagggctgtttgtcttcttttattactggtttgcgggtcttcattctttttcccacctgttttacatattgggcgtgcagcttcttattttggcggggtatcttgcctatcgctggtacaaagaccgcggtgtgtatcattggctcagctcggagcaggaagggacggacatcccgtatctcggttcttcagtgttctgttcagagctgtatgaaaagcagatggagctgacccggctgcagcaccagaagctctacgagaccgaagccaagctcgacgcgcgggtgacgtatatgaatcaatgggtgcaccaagtaaaaacgccgctgtcggtcattaatttaatcattcaggaagaggatgagcccgtctttgaacaaatcaaaaaagaggtccggcagattgaattcgggctggagacgctcctttattcatcaaggcttgacctgtttgagcgggattttaaagtcgaagcggtttccttatcagagcttctccaatcggtcattcaaagctataaacgattttttattcaataccgcgtctatccgaaaatggatattcgcgatgatcatcagatttacaccgatgccaaatggctcaaatttgcgatcggccaagtcgtcacaaatgcggtcaaatattcggcaggcaagagtgacagactggagctgaatgtcttccgcgatgaagacaggacgatgcttgaagtcaaagattacggtgtcggcattccctcgcaagatatcaagcgggtgtttgacccttattacaccggcgaaaacgggcggcgtttccaagaatctacgggaatcggcctccatctcgtcaaagaaattacgggcaagctcaatcatacggtggacatcagctcgtcccccggtgaagggacatcggtccgattttcatttcttacaaaaatgtaagactgcgttaagaaaacaacatagctcattctgtttccccttgataacatggatttacgtcaaggggatttttatgctgaatgccccggcactacatgaaagcagcccagatcaacaagaataaaaccataaggaggattctcatggcgaatatgcttgaagtcaaacatataaataaaacctataaaggacaagtatcctatcaagctttaaaacaaatttcattttcaatagaagaaggcgggttcacggcggtgatgggaccgtccggctccggaaaaacaacacttttgaatatcatttcaacgatcgaccggccggattcaggcgatatcctgattcacggagaaaacccgcaccggctgaagcggacaaagctcgctcatttccgccgcaagcagctcggatttgtgtttcaggatttcaatcttctggacacgctgacaatcggtgaaaatatcatgctgccgttaacgcttgaaaaagaagcgccgtctgtcatggaagaaaaactgcacggcatcgcgaaaaagctcggaatcgaggacctgctcaataaacggacgtttgaagtatccggcggacagcgccagcgggccgccatcgcaagagcggtcattcataagccgtcacttattctggccgatgaaccgacgggaaaccttgattccaaagcgtcaaaagatgtcatggaaacgatgcagagcctgaatcaggatgatcatgtcacggctttgatggtgacccacgatccggttgcggcaagctactgccgccgcgtcatctttataaaagacggcgaactgtttaatgagatttaccgcggggaaaaccgccaagtcttttatgagcagattcttgatgtgctgtctatgctggggggaaacgcaaatgacctttcttcagttcgcttataaaaacgtcacgagaaacaaaagggcctatcttgcattcttcttgagcagcgccttttccgttttgattttctttacctttgcgatgttcctgtttcatccggcactaaaggaaggctacctgaataacatcgccaaaaaaggcttaaccgccgcggaatggatgatctttgttttttctttcttatttgttctgtattcggttaacgcatttttgaaatcgagaaataaagaattcggtattctgctgatgcagggtattacgccggtgcagctgagaaagctcattacggcggaaaacatgatcatcggcgtcatgtcgatcgcagcggggattatcggaggcttcattttttcgaaaacgttctttacggtcggcgcttatattttagaaatggacgcgctgcctctgtacatgccttggaaagcgctcggcattacggccggcggatttctgctcttatttttccttttatcgcagttcacgatcctttttgtcagatcaaatacggtgatcaaattaataaagggcactgacaagatcaagccggagccgaagccgtccgtgcttctgtccttattcggcatcgcctgcctgtgcggcgggtacggcatggttctgaaaggcaatgtccacgggaccgagccgttcatcattttactgcttaccgtcatcggcacgtatttctttttcagccaaagcagcatctggattctgcgcgcgctgaagaagtggaaaaccttttatctgcgcgggaaaaatgttatttgggtttctgaccttgtctatcgtttaaaagacaacgcccgcctgttctttatcgtcagtattatttccgcggttgcctttacggcgacgggcgtgctcgcgatgtacaaatcgaccgtcggggcggaagagtccgcctatgagatggagtatttatctttcagcaataacccgaaagaacagactcatttgaaagatattgaccatgaactgaaaacacacggctttacgtataagaaagacaaaatagatgtttcctatgttcgctatcaggaaggagaaactgttccccctgtttatatgatcagcgaatcggatgtatcaacatacttccatgttaagctgaacggcctgaaacataatgaggctgtctatttcccgggcacgtatgaccgcaatttcaaaaacgacgcgccggatcagctgaagctgctgaaccaaaaaggcaagccgtctgaccaaaaactgacggtaaaagaagtcaaaaaaccgctgatttcattgaatgccatcatcgcggtgaacgatcaaacctttgatcagctgaaatcactcggtgagaaagcgtcattatacggctacagctatgatcattggaaagacagtcttgggatcagccaatccttgaaaaatgagatttacggcaactatatcgacgtgcattctgattttatggcaaaagccgggacgtactatgatacggtgcagctgccgagcctgagtttattcatcggcctgtttatcgcgatcgttttctttgtcgcggcagcgagtttcttatatttcaggctgttcaccgatttagatgaggaccgggagcgctaccgctcattggccaaaatcggtctgagtgagcgtgaaatggcacaaagcgtgacgatacaattggcgattctctttttctttcctttcgtcattgccgtcatgcatacgctgtttgctttgagaacattagcggtggaaggctattccgatgtagcggggccgctcagtctgaccatcggagggtttttcatctttcagcttctgttcttcctagcggtgcggacaagctatttgaaaaaaatgaacaagtaaggggagtgcacagatgaaaaaagcattggcaatcctggccgtcttagcagccgctgccgtcatatacggacttctcttttttcataatgatgttacagacagatttaatccgtttattcaccagcaagatgtttatgtacagattgatcgagatggcaaacatcttagcccgggcggtactgagtatacattagacggatataacgcatccgggaaaaaagaagaagtgacctttttcgccgggaaagaccttcggaagaacgcgtatttgaaggtgaaggcgaaaggaaagtatgtcgagacctgggaagaagtcagatttgaagatatgccgggctccgtacagtcaaaattaaagtgaacatgaaaaacggcacagtgtcatgactgtgccgctttttttattttttattttttattttcttcagcccgtttgatcagcatgtcggtgatgatatccatctgtttgctgacggcaatcgggtcatacggatagaaggtgttgaaatcgttgataaagacacggttgttctttacggcatcgagatttttccaaacggatgactctttcagacgctcaaatgttttgctttctccattcggattgtaatcggtaatgaacatataatcagccgcatattgagggatgacctcttgggaaacctgtttcatggcgcccgttttcatgatgtctttttcgattttggccggcgctttcaatccgagtgcgttataaacggcttggccgccgcggccggaattgtcattaaaaatccagatttcgcctttatccgtcgtttcataaaggccgactgtctcgtctttgccgatcacgtttttgaggcgcttttgatcggcttcagcctttttgttgaagtctgccataaagcttttggctttatccttcgccccggcaatgtcgccgaataggctgaccgtatctttcgtattctttgcggtgttaaaaggaatgacaatcgtcggtgcgattttcgatagtttctcgtattggtcatccttcatcagcacgattaaatcaggcttcagctgcatcactttctccacattgacgggattgccgatgtccgtggtgtttttcagctgttttttgataaacggatttttgaaagcccatgagcccgccccgacgacatttgcgtcaacggacagcagctcacccgcataaaagtcagtgacgatccgttttggatgtgcgggtatgtcaatatttccttttgttgattcatatgtacgcatgtctgtctttcctttgcctgatgccgatccgttgttttccttcgcgccgctgcaagcgcttaatgcgaaaacaagcagaagtgccaggccgatcagccatgattgtttcttcataatgatccccctatttcggtgataatgattatcattattaatatagcaggaagacgtcattccgtctatgttttttatagaaaaccttccttgattatccatgttatagtagtaaaggaggaggaatgaatgttgattacgaaaagagggacttggtgggaagtgctgcacagctggtggctgctgctgactttcgcgccgtttgggctgaccgctttcttggcctttttctatatcggctaccgggccaagaacaaaaaatggctgaaatacggacttatctattttattattttagcaattgcttttgtgctgccgagcacgccgggcgtgtatatcgtgctgcctttatgggtcatctccatcatccacgggctgaaagtgcgggcggcttatttaatacagcttgatgtgtttaaacaaaacgtcgaagcaagagcgtttgaagcggtaaggcatgaggcggaggaaaaattcggcggaaaacccgctcaacgcattgatctgacaaaacagagataaaaacaaatgacaaagccggtatctcgcgctttgtcatttgcatgaccggcctattgctggtatgaatgctgctgaaacggtgtgtgtgatgctgtgtttgcgggaatgaagaaacattagcgtttgccatcggtgcaggcatgtgtccgcttacttcctgctgaagctgattgcacacattcacgatttgctggcatttctgaatggccagttcatgcccctgcagcgcttgctgaatggtatgaacggcatgctgttcatggttaagcatctgctgaagcatttgaatgttttgctgttcctgctggagcatttgcttgtactgctgactgctttgctgtgtctgctgaataagctgctgtgctgtttgacggcattgctgcagctgatttccgctgtattggttttgatacatcatgaagacctcctgaagtgattgattttacacatttatcatgtgaaagaataggagaggcattcatgcaagaaaaggattcaaatatttacctgttatgtacagagcggaatacaaggctcgggatggcctgtcgagctttgtattccggccctttttctcagaagccgccttctgtagcgtgaaaaggaatattgagtctgttttcgactgcgcgcaggcgctgattcaaacggtttaagcggcgggtatggatttcaatggactggctcagccgtctgatctgctcattcatacgcgtgatttcccggttttggcgctggtcttcttgtgagaggcgggtgagctctctcgtttgctgggcgttttgtctttcaagctgggcgactctccgttctaaagccgtcggctgccgctcttcagactgagggggcgcataataatagctttcctgctgctgatacggctcatactcaacggggctcacttcgtattcctgctgctgagggaaataggcagatggggtgtagtactgatatgggttcattcatcattctccttatctagtgaagtctttatacactatgtagtcaattgcacagtgccacggcatccgcctaacttacaggcgtaaaaagagcttcaaaggaaggtgatcatgttgcggaacatacggattttcatcatgacggttcttgttatcggatgcgtcatgataacaggctgctcgcaaaagaaagcagacgaaccccctttttattacgggacatgggatgcggggctgaaaccgggcccgatggacggggtcagatctgaaaccgttacgtttacgaaagacagcgtgctgacaaagcaggtcattaaaggccgcggcgaggttcccatgccctcagatgcttacaaggtggtctcacaaaacacggacgggacgatcgagattgaatacctcggacatccgcaccccgtcaaaagcacgttgaaaagaggaaaaaacgatacgctcatttggaagatatacggagaaacaaaaacaatgacaagaataaaaaccggcggggaggatgcacatgagaaataaggctgccgacagactcgttttgacgggtgtcatcgtacatatcattcaatggttttcactgttatggttattttttatgctttttgatcagttcgggcgttttaccatttataatcccaatgtcgtcaacggcagcatgcagtctttttcattctttgatatgatgcgcgctcttctgttttccggcacgctgcggaatacgctcctgctgtttctgtttgcggcgatgctcatttacttgtgggtgaacgctctgtttatcctgctggaaatcgtttcttatatcatgatcaggcggaacagccgttcattatgggcatactttcccgcagcgatgggaataaagcttgcccttctggacatagcggccgtccctttctttgcggcggggctgatgctcttgaagcagaaaacagatgacagcggcgaacaagctgacaaggggaaaagacggccccgcatccggaggcaggcccggtataggaagagaaggcggagaaacttgtccgtttgatttttcattgaaacgaaaaaacgatatgatgaaagcataagcagaaaaggatacaaaggagatgcaggatgtacaagttaatcgcaatagatatggacggaacactattaaacgatcatcatgaagtgacggctgaagtccgcggggcgcttgatgccgccaaagcggaaggggtcaatatcgtcctgtgcacgggccggccgatcggcggcgtgcgtcggtatttggaagagctgaacttacaggaagaaggagactttgtgattgcctataacggcgcactcgtccaaaatacgtatacaaacggtgtcgtggccgagcagtcattaggctttgaagatttggagtcgctttacgagctgagcttacagttggatactccgatgcattactttgacacagccaatctgtacacgccgaaccgggatatcagtgaatacacggtatacgaatcatacattacgaaagtgccgcttcatttccgcacgatcgatgaagtgccgaaggatattctgattccgaaagtcatgttcattgacgatccggacaagctggagaaagcgatcgcttctattccggaatcattcagggaaacatacacaatggtcaaaagcgcgccattcttccatgagattcttcacccgaaagtcagtaaaggaaacgcggtcaagctgctggccgaaaaactcggcattgaacagaaagacgtcatggcaatcggcgataacggcaacgacatgtccatgattcagtgggccggctgcggtgtggcaatggccaatgccatcccggaagtaagggagattgctgattatgaaacgaaatcaaataacgaacacggcgtggcgcacgcgattcaggagcttgtgctgaaaaaataggcaccccatcagagggtgcttttttaccgcgtgttttggtgatatgataagcggagaggggaggcgcgacatggatcgtgaaaaacagcagctcagcatagaagcggcaaaactatattatcaatcagattacagccagcagcagatcgccgaacggcttaatctgtcacgccccaccgtttcaaggctgcttcagtacgcaaaggaaaaagggtatgtgcaaattcgcgtcatggacccgtttgaggatctggatgaactcggcgcgaagctggaagaaaaatacgggctgcttgaggcgcacgtcgtcttttctccaagcgacgattaccaggccattacacattacttaagccgctatggcgcagactatatgcataaaaccgtaaaggacggcgatatactcggcgtaagctgggggacgacgatgtaccagatcgcaagccgcatggagccgaagcaggtaaagagcgttgaagtcgtgcagctgaaaggcggcatcagtcattccaatgtcaatacgtattcgtcagaaacgattcagctgttcgccgaagcatttcagaccatgccgaggtatttgccgctgccggttatatttgacagcgccgatgtgaaacagatggtcgagcgggacagacatattaagcggatcattgaaatgggcagacaagccaatatcgccctgtttacggtcggaaccgtccgggatgaggcgctgcttttcagactcggctatttccgggaagaagagaaacaattgctgaaagcacgcggagtcggcgatatttgttcgcgcttttttgacgaggaaggcaggatttgcagcagcagcattaacggcaggacgatcggagttgagctcagcgacctgaaattgaaagagcgttcgattctggtggcgggcggcagcagaaaatgcaaggccattcacggtgccctgaaaggaaagtacgccaacgttttgattactgatcagcatacggccaaaaaactcattcaagaattgtgacaattcatgaacataatttcaattaccaatttacatatgttcaaaattcggttattctaaacgtatcctaggaaaaaggaagtgcatacaatgtcaattgcaagtcaaatagaccatactgctttgaaaccgcatacacaaaaagcggatattttacaactgataaaagaagcaaaagaatataaattcgcttccgtttgtgtgaacccgacttgggtcaaactcgcagcggaggaactgaaaggcacgggagttgacgtttgcaccgttatcggatttcctctcggcgcaacgacatcggaaacaaaagcatttgaaacgaaggatgccatctcaaaaggagccactgaggttgacatggtcatcaatatcggcgcattaaaagacggcgatgatggagcggttgaagctgatatccgcgcggtagttgaagcagctgataaaaaagcgctcgtcaaagtgatcatcgaaacatgccttttgacagatgaagaaaaagagcgtgcgtgccgcttggcggtatccgcaggcgctgatttcgtcaaaacgtctaccggtttttctacaggcggggcaacggctgaagatatcgctctcatgagaaaaacagtcggaccggacatcggggtcaaagcatcaggcggcatcagaacaaaagctgatgttgacagcatgatcgctgcgggcgcgagccggatcggcgcaagtgcgggcgtctctatcgtgagcggcggagacagcggcagcagcgactattaatcagcattgcggaagccgaaagcttccgccatcctctttctttgttgatgcataaaaaattgtaagcgaatacaaataaaaggagaacacatatgaagtatctcatcggaattatcggaatcattgtgtttttaggtcttgcctggcttgccagcaacggcaaaaaaagaatcagaatccggccgatcgccgtcatgctcgtgctgcagctgattctcggttatattctcctcaacaccggtatcgggaattttcttgtcggcggttttgcaaaaggatttaactacttgctggaatatgcatcagaagggattaactttgtattcggcgggcttgtgaatgcgaaacagacgacgttcttcatgagcgtgcttctgccgatcgtctttatatccgctttaatcggaattctgcagcattggaaggtccttcccttcatcacgaagtatatcggtcttgcgttaagcaaggtgaacggaatggggaaaatcgaatcttacaacgctgtcgcatccgcgattttagggcaatcagaagtctttatcagtttgaaaaaacagctcggctatcttactgaacagcgcttatacacgctttgcgcgtccgcaatgtcgacggtctcaatgtcgatcgtcggttcttacatgatgatgctgaagcctgaatacgtcgtgacggcgcttgtgctgaacttattcggcggatttatcatcgcttctatcatcaacccgtacaccgtcagcaaagaagaggatttgatcttcgttcctgaagaagaaaagcaatccttttttgaagtgctcggtgagtatataatggatggattcagagtcgccgtcgtcgtagcggcaatgctgatcggatttgtcgcactcattgccctggtcaacggcgtttttaacgcggtcttcggcattacattccaggcgctgctcggatatgtattcgcgccgtttgcgtttttaaccggtattccgtggaatgaagcggtgagcgccggaagcattatggcgacgaaaatggtatcgaatgaatttgtggcgatgcagacgctctcatccggcgatttccatttcagcgcgcatacacaggcagtggtatctgtattccttgtctcattcgcgaatttctcctctatcggaatcattaccggtgcggtgaaagggctgcatgaaaaacaaggaaacgtcgtcgcgcggttcgggctgaagctgctgtacggcgcaacgctcgtcagtttcctgacagcggcgatcgtcggattgattcactgaacataaatgaaggacaggtgatagatcatgagaatggtagatcttattgtaaaaaaacaaaatggaaaagaactgacaacagaagaaattcaatttttcgtaaaaggatacacggacggaagcatccctgattaccaggcaagcgcgctggctatggcgatttactttcaggatatgacggatcaggagcgcgccgatctgacaatggcgatggtcaattcaggggaaacgattgacctctccgccattgaaggcattaaggtcgacaagcactctacgggcggggttggcgacacgacaactctcgtactcgctccgctcgtcgcggcgctcggcgttcccgtcgctaaaatgtccggccgcggccttgggcatacggggggaaccattgataagctggaagcgatcgaaggcttccacgtggaattgtcaaaagatgaattcatcaagcttgtgaaccgcgacaaggtagccgtcatcggacaaagcggcaatttgacccctgccgataaaaagctgtatgcgctgcgtgatgtaacgggtacggtgaattccatcccgctgatcgcaagctcaattatgagtaaaaaaatcgccgccggagcagatgccatcgtgcttgacgtcaaaacgggagccggcgcgtttatgaaaacggatgaagacgccgtgaacctcgccaaagcaatggttcgcatcggaaacaacgtcggccgccagacgatggccgtgatttctgacatgtcgcagccgctcggttttgcgatcgggaatgctctggaagtgcaagaagccattgatacgttaagaggggaagggcctgaagacttaaacgaactcgtcctcacgctcggcagccaaatggtcgtattggcgaaaaaagctgagacattggaagaagcgagaacgaagcttcaggaagtcatgaaaaacggcaaagcgcttgaaaagttcaaagagttcctgagcaatcagggaggagacgcttctgtcgttgacgatccgtccaaacttccgcaggcggcgtacaaaattgacgttccggcaaaagaagcgggtgtcgtttcagaaatcgtcgctgacgaaatcggcgtcgcagcgatgctgttaggcgcgggacgtgcgacaaaagaggacgaaatcgaccttgccgtcggtattatgctccgcaaaaaagtcggtgacaacgtcgaaaaaggtgagccgctcgtcaccctttacgccaaccgcgaaaacgttgacgacgtgaccgccaaagtctatgacaacatccgcatctcagaaaaagcggaagcgccgaaactgattcatacgctgattacggaataagacaaaaaaggcacatacctcatcagtatgtgcctttttttttatggcatggttttatccaaatgaatgtcacggacggattgtttcggctgtttctttctcaaaaaacgaatgagatagcacaggatcatacaaggaattccgcagaagagggcgattctttgattgggatcaaatgcaaggcctacgcatgaagcgaaacataagatcacagcggcgatcggaacgagagggtataacggcgtgcggaaggtcagatccgcgacgcgtccgccgtttttcacataatgttttcgaaataacagctgagacagggcgatgctcatccacaccacgacgccggcaaatccggctattgccacgagcaccacgtagaccgtgcccggggcggcgatgcttgagatcaaggatatgcaggaaacggccatgctggcgagcagagcattcagcggaatgcctttcggcgtgacttttttgaaccgggcgctgatcatgttttcattcgcaagagaccacagcatccgggtggaagcatacagtccggagttggcgaccgaaagcaaagccgttaaaatcacgaagttcatgatatctgcggcgtatgggataccgatctgggaaaagaccgcgacaaacggactttcaatcacaccggcttccttccaggagatcagtccggacagcacaaaaatggcgccgataaaaaagatgaccgttctccaggcgacatttcggatcgaacgcggaatatcttttgccggattggcggtttcacccgctgtaattccgatcagctccgtccctgaaaaggcgaagcttacggaaatcattgcgatgaaaaccgcaagaaagccgttcggaaacagtccgccgtgtgaggtgaaattcgacagcatcggagcttcacccgaaccgtgcaatgaaatcaaaccgaacatcgcggcgccgcctaagatgataaataaaaggatggtgacgattttgacgctggaaaaccaaaactctgtttctgcaaacaatttaacggagaatgcattggcggcaaaaaggagagccgcgaaaatcgcgctccacatccagacgctgctgtggggaaaccagcgctgcatgaggataccggaagctgtaaactccgatcctaccgtcaccacccaattcacccaatacatgataccgaccataaaacccgtggacggcccgataaacgttgtcgcatacgtttgaaatgaaccggtcacaggcatggctactgacaattctccgagacactgcatgacaagatacatcatcaagccgccgatcaggtaagcggcgatcgtcccgcccggcccggcctggctcaatgtataccctgtgctcaaaaacagccccgtgccgatgacccctcccaatgaaatcataaataagtgcctgcttttcatcgtgcgctttagttgattgccgccttgatcaacatccatcgtgatctccccctttttgcgtggcatgagaatcttccggcagccgagatcacgcgtgccggatttgactttaacgtgacaatttaaatcccttcaatgcatgtaaaatgacgtgtgcggctgcccggcttgtcatatcgcgaaaatcaagtgtcggatcaacctcaacgatctcaatacccgagatgtcagcctcctgggctaaaaaccggaccgcctgaagcagttcctcggtatacaggcctccggggccgatcgcaggacagccgggcgcatgagcttgatccagcacatccatatcaaccgaaataaaaatggcgtcggctcttttttgaacggccggcaaagtgtcttgtatcgttcggagaagccctttctcccggatcatctccattgtatgcacgtctgcctgacgctcttttacatatttttcatatgccaggctgttgctgaactccctgattccaagctgaatcaggttttgtccgcttatgatattttcatctaacagacggcggaatggcgtgccgtttgtcggccctccgtcttctgtgttgcggacgtcgtggtgggcgtcgaattgaaagacggccgttgttcctttcgtttccgcaatggctttaatggtggaataactgatggagttgtcgccgccgagaatgacgggcacccagtcaggctggtccgtcagaatatcataaatggtccgataaatgtgttcgtgagatttgacgacatccgtgacgtgaatctgaatatcgccgatatcgtacagatggtcaatgacatgctcccgcagctccgcggaatatgcggaaatgccgccgagcgcccggcggatcgcaccgggggcaaagcaggcgccggaatggctgattgacgacttagaaagcggaacgccgatcaaagccggccctttgatcgtttgtcccgcccacgcttccgtcacatcgccgatccttgtcacatggcggtcgttgaagagggagccggctttttgcagaaacggatacttatccaagagcggctccctcccttgaaacgaccgtcttcccgttcttgatgacacggcggacatgattgacgccgtaatgatacgggatatacatgtaattcggcgcttcccaaatgacaatgtcagccgcccgtccggctttgatttgtccggcctcttcgccttttccgatcgcatacgcagcgttaacggtgacagcgtgccagatttcttctgcggtcatttttaaatgaagcgcggcaattgacataatgagctggagattttccgtcggtgagctgcccgggttgaagtcagtcgccaaactgacccgtacgcccgcatcaatcatctcccgggctctcgcataagtgtgttttccgagatagaaagtcgtgcccggcagcaggacggcgatcgttccggactccgcaagcttttcgatgccttcgtcagatgcccccaccaaatgatcggcagaaacagcatgcagctctgccgccaattccgcgccgccgagcgggtcaatctcatcagcatggattttcaggccgaaaccagcttcagccgcctttttcaggtagtcccgtgactggctgacggtaaagacgcctgtttctgtgaaaatatcggcaaattgcgcaaggcctttttcttttatgtcaggcaaaagctgcagcatgcgattcagaaattcgtcagggctgttccggtactcaggcggaatggcgtgtgctcccataaaggtcgtgacaaggtcgaccggctggcgctcacccagttttttcgccgcggtcagctgtttcagctccgtgtctttgtcgagtccgtacccgctttttacttccgcggtcgtgatgccgtatgacagcatgcgtccgaggtgaaaaagccctttttcaatcagttcttcttcggaggcggctttcgtgtctttgaccgttgacaaaataccgccgccttgcgccagaatatccaaataagacatgccctgaatttttaaattcagttctttttcgcgggaccctccgaatacaagatgggtgtggggatcgacgaggccgggggtgacgagccgtcccccgcagtcgataatgtctcctgcctcgtatcctttctccgctccttgatgtccggcaaaaacaatgcgcccgtcgtgaacgccgatgacggcattttccgtgacatgaagatcctgcatgctcccgccggatcgggggccgccggattccatcgtcagcagctggccgatgttggtgagtatggtatctatttgtttcggcatgttaccgctcctttttcatcggtatcataatgtcttgttcctcggcgacttgaaccgctttttcataacctgcgtccgcatggcggatgatgcccatacccggatcgcttgtcagaacgcgggaaagccgttgttccgcaaggatgctgccgtcagcgaccgcgaccattcccgcgtgaagggaataccccatgccgacgcccccgccgtggtgaaaagaaacccagcttgcgcctgaggccgtgttgatcagcgcgttcagcaccgcccaatcgccgaccgcgtcgcttccgtctttcatcgcttctgtttcccgattcggagaggcgacagatccgcagtctaaatggtctcttccgatgacgatcggggctttcagctcgccgtttctgaccaattcattgatggcgagccccatcttttcccgttcaccgtagccgagccagcaaatacgggacggcaggccttggaacgtgacttttttctgcgccatgtcaatccagcggtggagggcttgattttctggaaacagctcttttaataaagcgtccgtgcggtatatatcttcagggtcaccggacagcgcagcccagcggaacggcccttttccttcacaaaataaaggccggatgtaggccggaacgaatcccggaaaatcaaaagcatcggcgagaccctcatctttggcagcctggcggatgttgttgccgtaatcaaagacgatagccccttttttcttgaaggcgagcatggcttccacatgctttttcatactctgcttggaaagccttacgtataaatcaggctgatcccggcgcaggcggtcggcctcctcaagtgagtatcctgccggaatatagccgatcagcgggtcgtgagcggaagtctgatcggtcacgatgtcaatatggacgccgcggttcaaaagctcatgatgcacctctgccgcattgccgagaaggccgatcgataaaggttctccggcttgtctggctgtttcggcccagcgcagcgcttcgtcaattgatgcggttttccggtcgcaatagtttgtttctatccgtttatcaatccgtgtttcatccgcttcaacggcgatgacgacgccatcattcatcgtgacggacagcggctgggcgcctcccattccgccaagtccggccgtcagcgtaagggttcctttcagactgccgccgaaatgctgtctcgcaagctccgcaaaggtttcataggtgccttgcaaaataccttgtgaaccgatataaatccagctgccggcggtcatttgcccgtacatcatcagtccttttttctcaaggtcatggaaatgctcccaatccgcccatttcggcacgaggaccgaattagccagcaggacgcggggcgcgcggctgtgcgtgcggaacagtccgaccggttttccggattggatcagcagtgtttcatcatcttttaacgttttgagggagcgctcaatcgcgtgaaaagcatcccagtttcgcgcggccttgcctatgccgccgtatacgatcagatcctccggcttttcggcaacctccgggtcaaggttgtttcggagcatgcggagcacggcttcctgctcccatcctaagcattcaagttcggtgccgcggccggcgcggattgatttctttacatcagtcatcttgtaagtcctccttcattggtcatcagtttttggtgatgctcattcggcagaaaagactccttcttcagccagtcactcagatgttcgatgtcataagaaaacacgcggtcttcttgtatggacggcacgatgtttctcatttcgagatagagctgttttgtgtacgaggcgcaatgttccgcaccccggtattccacggcctgcagcgcgcaaatggcttcaacggcaagcacccgtctcgtattcgcgatgatctggtaggcgtgccttgaggcgatggttcccatgctgacgtgatcctcctggtttgccgatgaaggaatggaatcgacactggcgggatgggccagggttttattttctgacacgagggaggccgccgcatattgcatgatcatcgctccggattgtaagccgggctgagggctcagaaagggcggcaggtcattcagctgcggattcacaagccgttcgatacggcgttcagaaatattcgcaagctcggccgccgccactttgagaaaatccatggcaaaggcgatcggctgtccgtgaaagtttccgcctgagatgattttggcgccgtcttcgaaaatgagcgggttatctgtcgcggcattcatctcaatttctaatttttcttttacatacgctaatgtctgccatgatgcgccgtggacttgaggaatacagcggatcgaataggcgtcctggacacgcagctccccttggacggtcgtcagcttgctgtctgacaagtaatagcggattcgctctgcgacatccatctgttcctgatatccgcgggcggcatgaatgtcctcgtcgaacgcatcgataatgccctgaaggccttcgatcgttaagctcgcgatccgttccgactgataggccagcttttcggcctcgaggtaagcgatcagtcccatcgcggtcatggcctgcgttccgttgatcagcgcgagcccttccttagaggtcaggacggccggctgaaggtttgtcttttccaaagcatgagctgccggcatccgggccccttcgtaaaagacttcgccttgcccgataagcgccagtgcgagatgagaaagcggcgccaaatctccgctcgcccccagtgacccttgctgcgggatgaccgggtgaatgcgatgattgagaaacgcgagcagttgatcaatcagctcagtccgtacgccggaaaagcctttcagcagggcattggcgcgcaaaagcagcatggcccgcgatacagattccggaaacggatcaccgacgccgcacgcgtgagaaagaatcagattcagctgcagatccgcggcgtcttctttttgaatcagcacatcgctgaacttgccgaaccccgtcgtaatcccgtaaatggtcttctcttcttgaacgatccgttcaaccgccgccctgctttttttcacacgttccatgctttcggcagatgcttgaacctcttcaaaatcaaacagcacacgctgggcatctgcggttgtcagtgaggaaccgtctaacgttaccatcatttcaacccctttttctttactttggtaaagcgcccatacaaaaaggagctatgccatgaaaatgatatttcacgcatagccccctatcatctgatatctatgggctgattcatatgtgattaattccgactccgaatgtttcgtgctcaagccccttaatcggagctccgatcgtgccgtaaagggaaacggcgatccaatcgccttccgcctcgctttcatacggatttccccgcaagacggcaaacttcaggcccacggtacgaagcagcgagccaagcagcatttcgccccgcgtcactccgtgcaaagcttccattgtggcatgatacagcgcatgtgattcgcgataaccctcagattgaatgacgccgctctttttggaagcggtttcaattgcagctaccaccttatgcgcatccattgaacccaccctgccgagacagactttccagccgtcccgttccagccggctgatctgctggttttcttcagtctcatgaagcagaagaaggacggacaatcgcccgatgcggcggtctttgtgtaaggtcatatatgcttcactcaattcttaaatattctgataactagtaactgttttttatattaagtgtttgcgaatcagaagtcaaaactttttttccagtctttcacaaatcagattgctattgtattaaagcggtacatcgggaagccggcgctgttgatcacatatttccgccatccgcgtcataaaatagagcgttgtcttgaaagcgttttaagaaaagaagagagcgaggagatttcagaaaatgaaaaccagtttctttcgtgtgtgcctggtctcagcagcggttatcgggttcactctgccgcaggcaaaagcccagcatcccgttttttcagaggtcagcgtgcatgatccgtccgtcatcaaaacaggcgatacatactatgtattcggctcgcatttggcttccgccaagtcgaaaaacctgatgcagtggcagcaactgtcttcaagcgtcaatcccaataatcccctgatcccgaacgtctactccgaattaaaagagacattcgactgggcccagtctgatacgctgtgggcgccggatgtggctcagctggctgacgggaaatattacatgtactataacgcctgtaaaggagactcgccgcgatccgctctcggtgtcgccgtgagtgacaaaatcgaaggaccctacaaaaacaaaggcatctttttgaaatcaggcatggaaggaaaaagcgaagacggcacgacgtatcatgcaaacgttcacccgaacgtcgtagatccgcaaacgttttttgaccataaaggcaagctctggatggtgtacggctcttactccggggggatttttatactggaaatgaatccgaaaaccggtttcccgctcccgaaccaaggctacggaaaaaaactgctcggcggaaatcacagcagaatcgaaggcccgtacatcagctacaatccggaaacgaaatattactatctgtatctgtcattcggcggacttgacacagccggcggctacaatatgcgtgtggcgcgctctaaaaatccggacggtccgtactatgacgccgcaggccataacatgcttgacgccaaaggaaaagacggcagtttcttcgatgacaaagcaattgaaccgtacggggtcaaactcatgggcggctacagcttcgcctcacaatctgaaaaaggcacgggctacgtttcaccgggacacaactccgtgttttacgacgggaaaacgaaacgatcatacctcattttccacacccgtttcccgaacagaggcgaagagcacgaagtcagagtgcatcggctgtacatgaacaaagacggatggcccgttgcagcgccgtaccgctacgcaggagaaccggatacacacatatcggcagccgccgcatccggagcctacaaactcatccagcatggaaaagacattacagctacgatcaaaaccccaaaaaccatccggcttaacaacgacggcaccatttccggggaaatgaccggaacctggacaataacgaacagcagcaaagcccgaatcaacctgaacggcacacattatgacggtgtcttcctgaaagaatgggactcagcgagagagaaagaagttgtgacgtttagtgtgctgagcggtgatggggaggctgtttggggagtgaagtgaaaaagcacctactccagtttggagggtgcttttttcttgctaattaggagaatgaccttctattgcttttaataaaccatttgaattatgatggactcaacctctatcgtttacagtgaacagtataaaattgataacaaaaatatgaatacatacctaagaaaaaacgaaaggaagtttaattttgaaaaaaacaataaaagtagccgccgcagttatacaaaatgaaaacaatgaaattctatgtgctctacgttctccaacaatgtctcttcctaatctgtgggagtttcctggtggaaagcttgaagaaggggagaatgctcgggaagcacttgtaagagaaattgaagaggaacttgattgtaaaattgttacgggcgatgtgatagctgatattcatcatgaatatgagaaggtcatcgtcaatttaatttcaataaaagcgaggattgtatcagggaagccggtagcaaaagagcatgcggaattcagatgggtgcctattcgtgagctagaatcactagagtgggcacccgctgatcttccgaccgtatctgctttaattcgttaaatccacatacaagttttctgggacaggctgatggagcttccatttgacattcattggcttgtctccgtggcttgatacgtaatccgcttctcctaaataaataaatggtaaagtgatgttgtgcatttcagtgaatttcctcacaaataaatgaatatggtatcctttttccttatggtgaataaagttttgccctacgcttgatatatgtgaggtttggttttgactttgccagtgaaaatggctaggatcaataaaataatctttatatagcaaatgatcttctactttttctgacttattcaaattgataaagattaaatagtgatttttaactctacgtacaccctctcgccaagtcccttcctgatcagttgactgaaaaagataaatgagctcatttcttgtataggtctgatacaatgttagcttaatctcttttgaagcaagggcttctatattgttcatacgtctaaattcaatcagtccatagtggacgcgctccttaatatacggtccgaataatggatcggttaaaatctcgcttacttctggatctaacttgaatgtatcaccttgtaatgtaccaaagcgccaattctgtttttgatctgatttcgttaaacgctccattgctcgctgaatgaggtcatcatgtgtatctgttgtgatttgaatatgaaactgtttttctaacgattcttttacatcttctattgtgatgatatttttgtgaaaaccgctctgtaaaattaaccattcataaggccatttaataggtaattgctgttctaatcttgctactatccctacaaccaaggggttattgagaatcccttcatctgtaacattcaaatcgtccattttctttttggtctgtacccacgatttgtatttctttataaaaaaggtaagcccaggtgcctgttcagagtatagaaaatcaattaattctggagagcgccctagctcttgtttaaattgcttgtataacgttttcagcatggcatctgaatttagtttaatgtgatcgatcttatttaaaatttctttcttcgttatggctgaaaggtcaacataagatcctccaggtaaatctgaaaactcatgcgtcacggccactcggagggaatctttatcaaaagatttttggcttgtttgtccagatagtgcgagtggaataacgaatgacttttgatagtttccgataaaatccagtatcgttacaaactctttgtcgtcagtttttctaagtccccgtcctaattgctgaatgaaaatcgttggtgattccgttggtctaaggaacaatagtagattgagctttgggatatctattccttcgttgaaaatatctactgtaaatataagttctaaactgtggtgcgggtcctctaattgacgaatgacctcttgtctttttgcaggagaatcatttcctgttaaataagttgtataaaaacccaatttattaaattcatcactcatgtatattgcgtgttcgacgtttgtacagaaacctaagccaaccattttctcgccgtggaatccatacatgttgatcatcttgatgatatattctactcgtttatgcgtttttaaatgattgactagcgatttctcttcgtacagtccgtttttcacttttactttttcgtaatctacagtatgatctgaaattccaaaatagtgaaatggcgcaagtagctctgcctttagggcatcgcggagtctgagttcataaacaacattatgatcacaaatctgaagcacatctttaccgtcaagacgctctggtgttgcagttaaacctaataaaaactttggtgtaaagtagtttaatacagcttgataggtagatgcttctgcatgatggaattcatcaatcacaatgtagtcaaactcatctgttgaaaaagattccaaagtatcttttttatgtaacgtttgtatagtgctaaataaaaaacgcttatctctttcttttttcgtgccagtcaataagccaaaatcttcatgattatttgtgactttcttgaatgtttcgattgcttttgaaagtaactcttcccggtgggcaagaaaaagatatttatttggtttaaattgctcaaaatcaaatgctgctaaaaatgtttttccggttccagtggcggcgatgatgactgcttttgtctccccttcgtttcttgtttttttaaggtttcgtaatgcttccttttgcatggcattcggggacattttcgttttgtaaagagagttttgagcagcaaaggaagcacttaccttttggcttccagcttggaattcctcataggcttgtaaaaattgttcgtcaacaggctgtgtcttttcattccaaacagtgtcaaacaaatcttttgtttgttgataaacggggagatatctggtttcaggtagtctcacatttaactcatacccagtcgtaagggcagcttgtgatagatttgaagatcctacaatgacactatgctgtccagaacagcgttcaaataagtatgctttcgtatggaaagattttttatattcatttacaattctcaactcaacattttcaaattgaagaagatgtcttaacgccttcggttctgtaatacccatataggtagatgtaatgatgcgtacagggacatgtcttttagcaagctcctgaagcggagggatcaaaagctgaacaccagaccaccttgtgaaactaaccataaagtctacccgatccgccgttaacatttcgtgttttattgctttgaaaaagttctcatgagtttgatgatttcctagcagtttcagacgatgtagagaaaattcctctgaaataggaagttccatttcatttaaactataaagcactgtggaaagtggcaatgaaaaattcgtatgttttccaagctgagaggcgaccttctcgctcagctgaatcgcttgttcatattgatcttgatccacaagtgtttgaaatgtctcgctcagttgttttgccgtatgtaaagtcaaaacttctgcatattcttttgggctgaccggttgaatgcgatgtgatgttggataaagtttttgttgttgctgaatttcctcatggaagcctctatgatttctcatcataatctccttttttatatcaataattccattttatcactacttttaccaataggtaatactgaaaaagaagagaataaagtcctatttattaagcgcttaaaaaataacgctgaggtagtttggtttggtataaagacgtcatcgccacaaacggagaaagtctgtaagcgcaatgttccggagaaagccggcaaaattgacattcagcaaagagaggaggacaataaaagcagaaaggcgggattcatatgtttaaaaaaattcttgcagcagtagacggttcagacatgagcagcaaagctttggacgcagcgatccatctggcgaaagaacagcaggctgaactcaccattctttatgcgggacgtgaagccgttgtctccacatcagccttaacagggattgtctatgttccggaaaacttcattgaagacatcaaacatgaagtcgagcaaaaaggagcggccattctggaaaatgccaagcagaaagcggctgaaagcggggtaaacgcggaaagcctgtacgtccaaggcgaacctgcgcatcaaattttaaacatagcgaaagaacagcatttcaatctgattgtcgtcggaagccgcggaatcagcggatttaaagaaatgatgctcggaagcgtgagccataaggtctcacaattgtctccttgtcctgtactgatcgttcattaaacagaagaccctgctgatgcggggctttttttaatgagaaaagaccgccgtctttcgaaaaataggatgaaatcttcctctgaatcaagtaaaatggctgttagtatttgtctgaataaacagtcaatgatatgggggaagcaaatcaatgcaagctgaacaaacatcaaatgccgtcatcaaaatggtcatttccatggtcattttcggatcaatcggctttttctcggaacatacgaatgttccttcaattgaactggtctttgtgagatgtctgtgcgcctctttgtttctgggcgtttgctggtttggttccggacggcaccgcaccgaacaatggaaccggcgcgaggtgttgcagacattggcctgcggattttttctcgtgctgaactgggtgtttttatttaaatcgtttgaggagacatcagtgacgatagccatttccgtttatcatctggctccggttctcgtccttcttctagggagccttatataccgggagaaactgcatattgtgtccgtcacttccatcgtgatttgttttctgggcaccgccctgatttccggcatcaacggaaatacgtcattttctcagctgatgggatcgggtattatttgggccgtgctggccgcccttttttacgcctttacgacactggccgggaaaggtatcaacagtctcagcccatatgcggtcacctgtttgcagaccgggttgggcgttatcattcttctcccgttcgtccgtttcggcgctttttctgatttgtcgcatgtgaactggatcatgattgtgtcaaccggtatcattcatacgggaattgtgtatttgctcttttttgacagcttgcggtttttatccacccggtttatatcaatcatcgtatttcttgatccggcggtggcgattgtgcttgacaccgtatttacggggtttcgccccgacctttatcaatctttggggattgtgttgatttttgcgggaatggcactgtccctgattcgaaagcaaaaagccgtgccggcggaaactcaggcagacagcacccgtatataggcggccgtatcggctgctttttttgttttggggcttttcagccataacgaaaaagcagacaaacagatcatggaaaaagaggatagtaattgtataatacttcatgtgtttgcaatttaagagattaaaggagtgaagggcatgaaaaagaagacgcgtcatctcgctttcttggctgcactcggctttgcgctttgtctggccatcgtatgttccgcatccaagcaggcagaagcggcagcggcttatccggatgtgatgcagggacttaccggattcgctggcaatgcgaaggatcataacggaaaagcaaaatccgccgtatcgggaggccagggcggccccgtcgtctacgtcagcaatctcaatgatctgaaaaacaatgcgggcggaacggaccgcaaaaccatcgtcatcacaagtgatatttcttccccggggaaagccgttgtgacagtcggcgccaataaaaccatcgtcggctcttataccagccacaggctgaccaacatctatctgaccaccggctccggatcaaacaatgtgattttcaaaaatctcattatcagccataatgccgccattacaggcaacaacgacattccgatgtacatagcgaacgggcagaattactggattgaccacgtgtggtttgaaggacacagctacaatccgaacagccacagcgatttgggaaagcttctgtatgtcggcgccaaagcggattttgtgacgctgtctaactctaaattcacagaccatctgtacggcctgattctcggttatccgaatgatgataacgaaggacgcaattatatcggctatccgcatatgacgatcaccaacaactattttaataacgtctatgtgcgttcaccgggcctgatgagatacggctattttcacgcgaaaaacaactatgtgaccaatttcaatttaggattcaccattcatacaaacgcgactgtcttctcagaagccaactatttcggtaacggaaatgaaaaaggcggaatgatagacgactacgggaccgcccaattcaccgacaccggttcattcccgtcgctcaaagccccgaaatcaccgcgcaccggctggaatccgagatcaaattacagctacggcacgctttcagcccaggacgccaaaaacttcgcccaatcctacgcgggagcgcaaaatacaaatctccgctatccataatacaaaaaaccgccggcagccggcggtttttttatatgaataaaaggttcaaaattcctataatccttaaaataaccttaaatacctaggaaaatattgataaacaatttcaataatattactattgttaagcctatattacaaaagaaggaggagaacctatgaaaataggaaaaaagaacaagtggaaaaaatggctggccggcactcttgcggcaacgcttatgatttccattgcgcctgccgatgtatttgcggcagaaacgcgtgaaaaacaagatcaagcgaaaaccgccgccattccggcagcagacccggaaaaagatcttccggcggaaaaagcatccgagcagatgccgtttgatcaaaaagatatcaatcaagacggtgagatcacgtctgaaagaactgagaattcaaaactttattatgagggcgagggtgtatacaaacaggaaatctacacagaccccattcatacgaaagaaaccgccaatgcggactgggaagacatttctcctgaattgaaaaccggctcaaaggatgtcgggacggaaaatacagtgctgaactccgattttctgaagcaaatgaaaaacggattatacgctacatttgaacacggtgatcataagctcacatactcattaaccggcgcaaaaggccccgatcaggctgcaatcactccgacagatgcctcagcaaaagtgaaggaagacagcaacgagcttacgtatcagcaagtgtttcctgctattgatttacaaacctacacatttaacgaaaacataaaagaagaccttgtgcttcacaaatatgaaggctacaattccttcacctttcaaatcaaaaccgaccttcaggctaaagaacaggaagacggctcgatcgcgttttctgatgacaaagacaatgtcgtctacaccgtgccgaagccttttatgaccgactcagatctcgacgagaagtcaggtgaggtcagcaggtcagaagatgtcagcttcaagcttgaaaaaaacagcgaaggctacttgctgcatgtaacggccgatgaaaaatggctgaaagatcccaagcgggtttatccggtatctattgatccttccacatcagtatccgtgtcatccgatacctttgtcatgagtgcgtacccgacgacaaactactctgccgcgtcgcagaaatgggaggccggattgaaagcgtacgtgctgaaaacaggttattatgacggcacaaccggaacgaactacgcatttatgaagtttgataatctaaagccgatcaaaaacatgacggtgacaaaagcgacgcttaaagcatacacagcccactcctattacggatcaaaggcgacggggctttggctcgacaccgtaaacagcaattacgacaatgccaagatcacgtggaaaaacaagccgggctccaaaaacatcggcaaagccgaggtctataaaggccaatgggcaagcttcgatgtcacatccgcagtcaagtcgtggaacagcggcggcgccaattacggctttaagcttcacacaaacggcaacggaaaagaatattggaagaagctgatgtcatcagcaaactctgctaaaaaaccatacattgaagtgacatacacgattccgaaggcggacacgccgtctgtcaaagcgtatcataacggagattcgacaggacttttcaatatcagctggaaaaaagctgaaggcgccaaaagctataaagtgtggctttataacgggaaagaatatcaagccatttctgtcggcaatgcaacctcttggagcacaaaaggaaaaaacatctggccgacaaaagcagaaatcgactccggcaaatataagctgcatacagacggaaaaggcggaagtgaattagcgcttaatccttcgccggtctataaaaactccggcggcagctatccggcaagtaaaaattactgggtcgcggtcagcgcggtgtttgaccagggagaaggcgccatgtctgcggccgccaagcccgtcattccgaatattggcagagttcagaaaccaagcacgaaaggctttaataacaacaacgccacaggctggtttgatctttcctggaaagccgtatcaggcgcagccgggtataaaatgcaagtctttaacggcaaaagctttgaaacgcttgacctcggaaataaaacatcctggtccacaaaaaatcaaaacatctggccgacaaaggcggaaatcagcgccggaaaatatgcgcttcacctgaaagacaaaaaaggcgcggaattgccgatcaacccgggccccgtttataaaaatgccggcggagacgcaaaccggaaaacatacggatttaaagtaatcgcctataacaaagacggagaagcgatcgcctcaccggaagctagtccggcgctgcctgatatcgcaaagccgaaaaatctgacaggctacgtctatacgaacacgaaatcgagccaaacgggttatgtcaatctcatatgggataaagtcaaaaacgccaaaggctacaaaatcaacatctacaacggaaaagactatcaatcattcgatgtcggggataccgatcattggacgacccaaaacaaacacatctggccgtcagccgatgaagtgaaagcgggaaaattccagcttcacacggacggaaagggcggcgaactggcgcttgacccttcacctgtttacgaaaacgcaaacggcaattacaaagggaagaagaactattcctttacgctgaccgcctatgacgcaaatggtgacagtataccgacggcaccttttaaccctgttttccatgaaggtgcggaattcctcggaacggaagaattctggtctattatcgacattccggacggacagctgaacggcgcgacgggaaatgtcatcgtcaatgaagaagatatgtcaatcgacggacgcgggccggggctcggactctcccggacctttaacagccttgacagctctgaccatatgttcggccaaggctggtatgccgatgcggaaatgtcgattctttctgaagacggcagagccgtttatattgatgaggacgcgacaacacatgtcttcacgaaaaaatctgacggcacgtatcagccgccgacgggtgtttatctcgaactgacagaaacaagcgaccaatttgtattaaaaacaaaggatcagacgaacgcttatttcagcaaaaaaggcggcaagcttcaaaaagtcgttgacggacacaacaacacaaccgtatacgaatataacgacagcaatcagctgaccgccataacagacgcatcagggcgcaagctgacatttacctatgatgaaaacggccatgtcacatctcttacagggccgaaaaacaaaaagatttcgtattcatatgacaaagaccttctcaaaaaggtgacggatactgacggcagcgtcacaagctacgactatgatgccgaagggcgcctcgtcaagcagtattccgcaaacagcacggatgacaaaccgctgttcactgaataccaatacagcgggcaccgcctggccaaagccgttaatgcgaaaaaagaaacgtatgattacagctatgacgccggcaaaaaaacgctgctcatgacgcagccgaacggccgcaaagtgcagtacggctataacgaggcgggcaacccgattcagatgatcgatgatgccgaagggctgaaaatcacgaccaacactgtatacgaaggcaacaacgtcattcaggacaccgatccgaacgacgcggatgcgggcaaagcgacagaaagctatcaatatgataaagacggcaacgtcacagccgtaaaagacaactacggcaccgaaacgtatcagtacaacaaaaacaatgacgtaacgaaaatgaaggataccgaggggaacgtcactgatattgcgtacgacggacttgatgctgtttctgagacggatcaaagcggaaaatcctcatccgccgccgtgtatgacaagtatggaaatctcattcaatcaagcaaagagctggcagcttcggcaagcctgctgaaagacggcagctttgaagcaacaaagctgggctggaatctcaccgctacgagagacagcggaagcatcgcgtctgtaaaagcaagaagcggcgcgctgtccggacaaaaagcactggagatcacctcacaatccgcttcagccggaacagagcacggccatgcgtccgcaacgcaggaagtgcagcttgagccgaatacgacgtatacactcagcggccagatcaaaacggatctgacaaaggcgagagcgtatttcaacattgatctgcgtgacaaagaccaaaaacgcattcaatggattcacaatgaatcaggcgcattagccggaaagaatgactggacgaaacggcagattacctttacaacaccggccaatgcaggaaaagccatcgtctatatggaagtggatcataaagacaaggacggcaaaggaaaagcgtggtttgatcaggttcagctggaaaaaggcgaagtctcttcaagctataacccggttcaaaacagcagtttcacggctaaagcagatggctggagcacaagcggagccgccgctgaccttgatgaaggcttcgatgatgacagctcattaaaagcgtcccgcacaaatgcatcacaagccaatgcggccgcaaaacaaaccgtcacattaggccaaagcgcggacgataagccggtatatatcacgctgacagggatgtccaaggcagacggcgtaaaattaacgaacgacaatgattacgcgcttcaggccggcgtcacctatgcggacggcacgacgggcgtctacaccgccaaattcccgcaggggacacaggaatggaaccgggcggcggcagtcattccgaaaacaaagccgatcaataaaatcgaaatcagcattctgttccaaaaaagcgccacaggaacggcgtggtttgatgacatccgattaatcgaaggaagcatcctgacgaaaaacacctatgacgaaaaaggaaactacgtcacaaaagaagaagacgaactaggttatgcaagcactgcttcatatgacgagactggcaagaaaatgtctgaaaccgacgcgaaaggcgaaacaaccgcctacgaatacgatcaggccgaccagctgacaaagctgaccctgtcaaacggcacatccatccttcacagctatgacaaggaaggaaatgagctgacaaaaacgattcgggccggcgcaaaccagacctatcaatatgaatatgacgtcatgggcaagctcgtcaaaacaaccgacccgctcggcaatgtactgaagagtgaatatgacgccaacagcaacctgacgaaaaccgtttccgccaacggcaatgaagtgtcgctgacctatgacggcaccgaccgggttaagtcaaaagcgtataacggcactgaaaaatacaactttacctatgacaaaaacggcaatgaaacgtcggtcacaaacaaagaacaaaatacaacgaaaaaacgcacctttgacaacaaaaaccgcctgaccgaattaaccgaccgcggcggcagccaaagctggacgtatccggctgattcagataagctgaaaactttctcatggagccacggcggccaaaaaggaacaaacagctttacgtacaacaaacttgatcaaatgattgaaatgaaagacggcacttcagcctatacatttgattatgatgaaaacggcaatgtccagacattcatcagcggaaatgaagtcggcacgagcttctcatatgatgagcggaatcttgtcagctctcttcatatcggagcgaaaaacggcggcagcatcttccgggaaagctatgaatacgacgccaacggcaaccgcacggtcatcgacagctcagccggcggaaaggtgcagtacgaatacggcaagctcaaccagctcgtcaaagaaactcatgaagacggcaccgtcattcaatatacgtacgacggcttcggcaaccggacaaacgtcaccaccacaaaggacggcgcaagcaaatcagtcaacgcatcattcaatatcatgaaccagctgacgaaggtgaatgacgaagacctgtcctatgataaaaacggcaaccgcatatctgacggcaaatacacatatacgtgggacgcggaagacaacctgaccgccgtcacgaaaaaaggcgaagacaagccgttcgcaacatacaaatacgatgaaaaaggaaacagaatccaaaaaaccgtcaacggaaacgttacgaactacttctatgacggagacagcttgaacgttctgtatgaaacagacgccgacaacaacgtcacaaaatcatatacgtacggtgacagcggccagctgttatcctatacagagaacggcaagaaatatttctatcactacaacgcacacggcgacgtcatcgccatctcagacagcaccggaaaaaccgttgccaaatatcagtacgatgcgtggggaaatccgacaaaaaccgaagcaagcgacgaagtaaaagacaaccgctaccgctacgcaggctaccaatacgacgaagaaaccggcctgtactatctcatggcccgctactacgaaccaagaaacggtgtattcttatcactagacccagacccgggcagcgatggggattctttagatcagaatggatatgcatacggaaacaacaacccggtgatgaatgttgatccagatgggcattgggtgtggctagccattaacgccggctttgcggcttatgacggatataaggcatataaatcaggtaaaggatggagaggtgcagcctgggcagcggcttcgaactttggtcctgggaagttatttaagggtgctaatcggatttataaagctgctaaaacatataaactatctagaaaaagtgtacgggctagaagggcctactcaagttatagggatataactggaaaaacttctaggttcaaaaattattctactaatgtaaaaagaagaacttttgaaaaaaatttaagaagacaaggatggagaaaatcagttcatcatgggggtgttatcactatgacgaaaaatgggaataagtattccctaaggaaacatgctaagtcaagtccctatccaaccgcggaatatacacctaaaggtagaaaaaaattcacacacaaaatcagaatgcgacattaaaggggaaataagatggatcactattttattgatcatcctaaggagttaaaagtctatcaatccataattaattccttatgtcacgtagatcaaacattgcctaaacaagtttttaagcaaaggaaaaattattatttattcgaggaattccattgggtattatctgaagaaagttggggaatgtttaagagtttggctaatgaacatcatgatgagtttatattaatggctgttatagacagttctgaacatataaaccaattctacgaagaatttgagtattttaactggataaagatccctttgcatataactgcagatgagtatctgtcactcttaactgattatccaaagcacagtaaaagtgactgtataatgaatattgcatctcgtgttgtttgggcttcaccgactttaaagtgggcgatttatggtgagagagaacttgaaatctgtattctaggtattgatcatcagagtgaaggaaaagaactagcaacttggagatcgttagatggcgttgtcttagattggatatcagttgtattcccaaatcagacggttccagttgaatttgaaaaaacacttacggcacattacaaataagtatatttttaatacctactaccgatatcatctgattgttctaaacgggatttcaaataatctccagatagtatttttgcattcaacagatatttaatgacaaatatgcagagtaatatatttttggggcttgtttgaataatctatgtttatcatcaagacacttctatcaatgggtttgttagtgttagttaggagaaggagaagacaatgcacaaacaaattgaacaatagagtagattatattgacgagggatgtaatattttaaaggtcgattatcagttctttaaaaaagacctgttttaaggttcaggttgttaaaaatgcagcatctgtttattttagtgcagatattggtgatatgagattagaaaaaatagattcggaagaatacaattggcaagtatttgagatgagttaccacccggaaggaatcggtaatctatcaaatgctgtaattccggagtatcaatcaaatgctaattttctcattgacatgaacagaatgctgattgctgtagaagctgaaacagttcgctttgacgaccaatcattttatgcgtatcatccgaaatcataaataaacaaataagagaggttcccagcctctcttttcttacataacgaaatcgttcgcggaggcaaacatgaacactcctttaaatttacaaaaagaatcattgagggctatagggaatctggatgtgattaatccgcttaaatacaattcgatttattcatgtgatctagtgagtaaagatactttttctcaaattaatgaatgacttagagttcgaaacagctctaatagaagtaatggcattcccttcttttattgaagaatggaagaagaaggttgaaaagaaaatgataaatatgaatactgtatcgaaaaagttcattcatattgaatgtgtcctaaccaaagaagaattgatggcagattacttattagatgaattatattttttagcatcgatcaatgattttgttgttataatagcaaaccctgccaaaaataagtcctgcatgaacctgaacactcaaaaggttgatgtaactactgaaagtaatgaaaaaatcatttggtttgaatacgatgcagcagatttatatatcattgattaatttaatataaatttcaggttcctattcaacggagtgttgctgatgttaaaacttaccgcggagcgtgttgggtcatatgaaagggaaaatatcatttatttcaatgcgggtcgggatgatcaagtatttattgtgtcggtgcacgatcacaaagtaatattggaggttatgaaaggcagctctcttttaatcaaaaaagagttacacggattttctgaagatgcccatttctatctgattgattcgtatgatgacactatcgtgatcgtttacctggagaatcatacgtgtcaattggctgcatactgcgtaaacagtaataaaatcaatccgatttgttcttttctattaagcgccaatgtatttcatctgggtgaggatggattattatggatcggattaacggacgagggtatgtatgatgagagaaatcctcaaggaaaagcgatatttgcttttcatgcagaagacagaacgttttattttgaagacgattttaaagaaatgatgcacgaatgctatgccgtacaatcgatcaaatctgatttgtatgtatgtttcgagggagaggattgctgtgtcatcgggcattatcagattggacgggacagaattcgtactgttgcagaatatgtgctggacggcgatcaatactcctattgtgatcagctatccgtttcgaaaaaaagggtgctgctgattcagagtcacgatgataccctatttgcatttcatgaagagcacaaagagactgacgtcatgatacacggtattgatagaaaaggagaaacaacgtacagagccgtacaggatcgcatgtttatctttagtgataacgatttatatctggtaaagtattgatcaatcctatgcagatggctttttacagccatctgcatatcattttacggagtgaacgatcgatataaataggataccatccaagactcaaggggcaatgacatgaaaataaaaatgaataagatagtcgaagaatcagtaaaaggatgtttttgtcattttgataactgcgggcgtctgtatctcggacggcatcagaatggcgggctttcgtttacgatcatcgacaaatcgggcgatacgcgagtgattcatatcgatgaacaaatcccgtatgaggatattatgctgttccaacagagttcggctgactggtatgtgttgattttctttgaatcgcatgagtataaagtgaaagtattttcagcagaaggaacagaacaaagtgcattttctctcccttcaggggtttcatgcagtcttttggatgaaaaacaaaacctgtggatcggtttaagtgatgaaggtatttatagtgatgaaaatcctgaagggcacagtgtgctgtgcttcactttagacgggcagctaaagaaaacccacattgatcagcagctttcagaaatatatgcgcccgcggtagatgactgttatgcacttgcagaaaaagacggactaatctacatgctgtattacgcttatacagtcattgctgcgtttgaagaaaccgacgtgaaacgagtgtggattatttctgataaagcatattccggggtttacgaccagctagcgatttcagataacgggttttgggtatgcaaagatgatcattcactgtctctcattccggccgatgtcagtctgccgatgcaagagataacgtgctgtgatgcggatggcgatgagctttccgggcatcagctgaagctgactggcgatgccatttacgcggtctcgaattcagggatttataagcgggatatcagtaatgggaaagcggctaaatgagatgttaagatccaacagatattctttaaataatgacgtcatcagaagcttgaaattacacaaaaaagaattagaggggccgctgccttcagatgcagggagattcgaagaagactttgagggtgctgcctgcgctggggatttttatgaatacttcgcacttgtctgcggcagcttagattttgttttggcgaataaacaaatgcctgcacggcagcgtaaagccttatataaatccttttttgagctgtatccgcaatatgcgcagctgaaaaacgctttgatggattatccggagctcagccaggaaatcgggcggcacgaacgggccaggaggctgttagtcagcattttaaacaagaaatgaaaggcaggattttgacgtgaaagaacccacaagagcagaatgtctgaaaaaggctggtctgatcctgaacggtcaagcggcgagggaagaagtgtcggattgggcgtctgagtatgtgagtgcaggtgatccggcggatgaggacgaaaccgtttgggagatgctcgtatatttgagcgggtttgatctgaaagattcgcctgatgcgtatctgcatacgatagaagaattaagagattgggtgcaggaatataaagaagttcatggggatttgtaagaaaaaaattcatttgagtcagacatgtcaattcagctgaaaaaaaggaggcgcaaaatggaatggcacaaacatgagaaagcagttctgccggggccaggttcgccgggttgttttgaattgacggagtttacgttctataccgggtataacgagtattatgataaaatcccggtgtttgagctgaagctgactgacggacagtatgatgccgtgctgcggtttgaggatgtgaggtctgcccggctggatgatcttgaaagcatcaccgacatccatctggatatcagcccagtcgacggcggctgggaatcgatccgctactatgtcgatgacggggaaggaagtatgagcttttattgcgccaaatgggtcgtgctcgacatgaagaaaaagcagtcccccgaacggcccggcaaaacgtcagggtaaagcggcggcatttcgcgtataatgaggggagccggacagagaaggagtttagtcatgaatgagtttaatgaatatgcgatcagccccgagatccgacgggcgctgaatggcttgcaatacaccgagccgactgaagtgcagcggcgcgtcatccccgccgcgctgcaaaaaaaagacctcgtcgtcaaatcgcagacgggcagcggcaaaaccgcggctttcggcattccgatctgcgagcttgcggagtgggaggaaaacaaaccgcaggccctgattttaacgccgacccgcgagcttgcggcgcagattaaagaagatatcacgaatatcggccgtttcaaacggataaaagccacggcggttttcggaaaagcttcttttgacaaacagaaaaccgaactgaagcaaaaaagccacgtcgttgccggaacgccgggacgtgtgcttgatcacatagaaaaagggacgctgccgcttgaacggctggcgtatgtggtgattgacgaagcggatgaaatgctgaatatgggatttattgaacaggtggaagccatcattcagcatctgccgaaaaacagagtcaccatgttgttttcagcgacgctgccggatgacgtcgagaagctgagccgcacatatatgaaagaccctgaattgattgaagtaaaagcggaaggcctgacgacaaaagacattgagcattttgtcaccagaacagaagaagaggataaatcatctttgctgcgtgatgtcctgatcaccgaaaacccggacagctgcatcatattctgccggacaaaagaaagggtcatccagttaaccgatgagctggacaggctgggctacccttgtgataaaattcacggcggcatggtgcaggaagaccgctttgacgtcatgaatgaattcaagcgcggcgagttccgctatctcattgcgaccgacgttgccgccagaggaattgatatcgaaaacatcagcctcgtcatcaattatgatattccgcttgaaaaagaaagctatgtgcaccgcacaggcagaacgggccgcgccggacaccgcggacgggccgttacgtttgtgacgccggctgaatcgcggtttctgaatgacattgagacatatatcggtttccgcatccaaaagcgggaggcgccgtccgagaaagaaacagcggaacggaaagcggcttttgcggaaaaattgaacgcccgccccgatgtcaaaacagacaaaagcgaacagttaaacaaagacatcatgaaactgtactttaacggcgggaaaaagaagaaactcagagcggtcgattttgtcgggacgatcgcgaaaatcgacggcgtttcagccgatgatatcgggattatcacgattctggacaacgcaacatacgtcgaaattctgaacggaaaaggcccgcacgttcttgacatcatgaaaaatacgacggtcaaaggcaaaaaactgaaagtccataaagccaagaaataaaatagaaagcctgccgcgtgcaggctttttttacgccgtttcctcaggcacaaacgcaaggatggcaatgccgatcacaaataacaaaatcaggctgaacacggcggctgacgaatttccggtcagctgggcggtgacggcaatcaaaagcgggccgataatcgaagcgaacttgccgaagatattataaaatccgaaaaactcattggcgttctgtttggggacaagctttgcaaagtaagagcggctcagcgcctgaatacctccttgggaagtggcgacaagcatagccaaaacccagaaatcaaaagcggaatccataaaataagcatacgtgcagacaatcatatacacgccgattccggcataaagcattgtttttcctttaaaccgttcggccagccgctcgtacaaaatcgaaaaaggggcggcgacgacctgtgtgacaaataaaacaatcagcagatttgccgcgctgatgccgaggtcagccccgtatgacgtggacattgtaatgatggtgccgaccccgtcgatatagaagaaataggcgagcagaaacaaaaacagcgcccggtgcttcctgatctgcttcagcgtgccggccagccgtataaaactgctgatcacaagccgcggctccctctcgatataatagcgctggcggacgcggagaaggagcggaatcgaaaacagtccccaccatgccgccgtaattaaaaaggcaatgcggcccgcagtctgggcggacagcggaatcacctccgcttgtgctgacagaatcacggcaatgctcaggagaaaagggattgtactgccgatatagcccagcccaaaccccctggcggacaccatattcatccgctcctttgcggccacatcaacgagaaacgcatcataaaacacattagatccggcaaagccgatcgtggaaatcgtataacaaattaataacagcatccaagattcgccgggaatcaaagccagcgcggcggtgcccgccacaccgatcagaaaaaagaaggcaaaaaaccgtttcttgcatcctttgtagtcggcaatcgttcctaagacggggctgagcatcgccaaaataaaagtcgcggcggcaatcgtatagcccaaataagcggtggaatcagctgcgctgacgccgttttccgccgccgccgctttaaaaaacaaggggaacaccgccgtcataataatgaccgaataagctgaattggcccaatcatacagcatccagctgctttcttctttcgaaaaccgtttcatcacacacgctccttcccaaaaaccggttctctgcattatatgcgcctctgcctcatcgttggacaatgatttctgaacggcgttttctgattgacctggagatattgacctggtacaaaaaggatgtacaatcaaggtgtagcaggtaaatggtcaggcgggagggagacggaattgaagattgcgaaagtcaataataataatgtcgtcagtgtgctcaaagaaggcaatcaggaattggtcatcatgggccggggcattgcttttcaaaagaaaacgggagatccggcagatgaagcccgcattgagaaagtgctcaccctcgataacaaagatgtatccgaagttcaaaacccttttgtatgatattccgatcgagtgtatgaaagtatccgaggagattatcagctatgcgaaattacagcttggcaaaaagctcaacgacagcatctatgtgtcgctgaccgaccatattactttgccattcagcgcaataagaaagggctggatatcaaaacgccttgctgtgggaaacgaagcggctctacaaagacgaatttgcaatcggaaaagaatcgctgatcatggtaaaaaacaagactggcgtgtctctgccggaggatgaagcaggttttattgcgctgcatattgtaaatgccgagctgaatgaggagatgcccaatatcatcagcattacaaaagtcatgcaagagattttgagtatcgtaaaataccattttaagattgaattcaacgaagaatcgcttcactattatcggtttgtcacccacttaaagtttttcgcgcagcgtctttttaacggcacacatcgactttttgctggagaaaaataccgtcgggcgtatgaatgcacgaagaaaatccaaacttgcattgagagggcgtatgagcacaagctcaccagtgacgagctgctgtatttaacgattcacatagaaagggtagtcaaacaagcataatgaaagcgttggcattattgttcttggattcattttttcttacattcacatatgatcttgttaggattgttgctgataagcatgcaaaacctaaattacaatgagcgcggatcatttctgtttgtgctgatggtaatttaggtttttttaagattcgttattatcattattctgaccgatgttcccttttaacagaatcatgtatgatcgataaagaaatcgctctcaaagaaaggggaatgccgacatgttttatcgtatgaaacgagtgctgctcattcttgtcactggattgtttttgagtttgtgtgcgatcacttctgctgcatcagctcaaacaggcggatcgttttttgaaccttttaacagctataactccggtttctggcaaaaagcaaatggttactccaatggagatatgttcaactgcacttggcgtgcaaataatgtatccgtgacgtcatcaggtgaaatgcgtttggcgctgacaagcccgtcttataacaagtttgactgcggggagaaccgctccgctcaaacctatggctatggactttatgaagtcagaatgaaaccggctaaaaacacggggatcgtttcatcgttcttcacttatacaggtccaacggatggtaccccttgggatgagattgatatcgaatttttaggaaaagacacgacaaaggttcaatttaattattatacaaatggcgcgggaaaccatgagaaggttgcggatctcggatttgacgcggccaatgcctatcatacgtatgcgttcgattggcagccgaactctataaaatggtatgtcgatgggcaattaaaacatactgcgacaagccaaatcccgacaacaccgggaaagatcatgatgaacttgtggaatgggataggtgtcgatgactggctcggttcctacaatggtgtaaatccgctatacgctcattatgactgggtgcgctatacaaaaaaataatgtacagaaaaggatttccgccagcggaaatccttttttaattaaaacgaaataatcccaatcaaaagcgccgcaatcgtcatcacaatcgttgttcccacggcccatttaatagtgaatttttgatggtcgccaaagctgacgcctgccattccgaccaatagataggtggatggcacaagcgggctgagcagatgcaccggctgtcccagcaaggaggctcttccgatttcagcggcgtctattccgtaagcggaagcggcttcggcgatgatgggaagaacaccgaagtaaaaggcgtcattcgacatgaaaaaggtgaaaggcatgctggcaatcgccgtgatcaacggcagatgcggacccatggcatcagggatgagggaaacgagagaatgcgccatcgcatcgaccatttttgtgcctgagagaatgcctgtaaatatgcctgccgcaaacaccattgagacaacgtttaacgcattacccgcatgcgccgaaatccgtttctgctgctctttgacatttggatagttaatcatcaaggcgatggcgaacgcgatcataaaaagaacagggatgggaagcaggctggtgatcagcgcggccatcagagcgacagtcagcagcaggttaaaccactggagagcgggacgcttcagcggcgccgcctccggatcagaagacggcgcgtgttcaatcgaaatgatgccgagacgcttccgttctttttttccaaggagataagcaacggcgatcacccagagaacgccggcgatcatagcgggaatcagcggcgtaaaaacttctgacgtgtccaatttcaaggaagccaaaaccctcgccgtcggtccgccccacggaataatattcatgacgcccgaaccgagcatcgcaatccccgccagcaccaaacggttcatgccgagccgtttgtaaaggggcagcattgccgcaatcgtaatcatatacgttgttgtcccatctccgtccagcgaaatggtcatcgtcagaaccgctgtgcctacggcgatttttaacgggtctcctttgacaaacgataagattttggcaatgagaggatcaaacaggcctgagtcgatcataatgccgaaatacaggatggcgaataacagcataatcccggtaggagcgaggtctgtaacaccctgaatcatcatcccgccgagatctttgccaaatccgctgatcagggcaaacacaacaggaacgacaatcaaagcaataagtgcggaaagccggttagacataataaggtacataaaaacaatcatcatcacaaaaccgagtatggcaagcatgatatgacctcccctgttcaacagctgttttggtaagcgctttcacattttgtttctgtgaaaatggcttatttcaaaatgtgtatgaccgcatatgtaaatacagacctaaaatcctaatgagcggatcagcagtttatttaaagaacgccgcgggtaaatgtgctgtagaatgtttcgttttaaaagggggaactgacatgagtgatgatcaaaacaaacgagtaaatgaacactcaaaggacgaacagctggagcagtaccgatctgataacagcggcaaaaaaatgacgaccaatcaggggcttcgcgtgtctgaggatgagcattccttaaaagcgggcgtccgcggccccacgctgatggaggattttcattttcgtgaaaaaatgacgcactttgaccacgagcggattccggaacgggttgttcatgcacgcgggtacggcgttcatgggcattttcaggtgtacgaaccgatgacggaatatacacgggcgaaatttttgcaggacccgtccgtcaaaacacctgttttcgtccgtttctcaacagtggcgggctccaaggggtcagctgacaccgtccgtgacgccaggggatttgcgacgaagttttatactgaagaagggaactatgacctcgtcggaaacaatattccggtgttcttcattcaggacgcgatcaaattcccggatctcgttcacgccataaaaccggaaccgcacaatgaaatgccgcaggctgcgacggctcatgatacgttctgggattttgtcgcaaacaatcctgaatccgcgcacatggtcatgtggacgatgtctgaccgcggcatccctcgaagctatcggatgatggagggcttcggcgtgcatacgttccgtttcgtcaacgagaaaggaaaagcgcgctttgttaaattccactggaaacccgtgctcggcgttcattccctcgtatgggatgaagcgcagaaaattgccgggaaagatcccgatttcaaccgccgcgacctatgggaaacgattgaaaacggcggcaaagtcgagtatgagctcggtgttcagatgattgacgaagaagatgaatttaaatttgatttcgatatccttgatccgacgaagctgtggccggaggagttggttcccgtcaagctgatcggaaaaatgaccctcgaccgcaatcaggacaatgtctttgcggaaacggaacaggtcgcctttcacccgggaaatgtcgtgccgggcattgatttcaccaatgatccgcttcttcaaggccggcttttctcttatacagatacacagctcatccgtcttggcgggccgaattttcacgagattccgatcaatcggccggtctgcccgttccataacaaccaatacgacggctaccaccggatgacgattaataagggccctgtcgcctatcataaaaattccctgcagaacaatgatccgtcgccggcctcagaagaagaaggcggatacgttcattaccaggaaaaagtagaaggcagaaaaatccgccagcgcagtgagagcttcaatgactatttttctcaggccaagatgttctggaacagcatgtctcccgccgagaaagaacatatcatctccgcgttctgttttgaagtcggaaaagtgaacagcaaggatgtgcagcagcaggtggttgatgtcttcagtcacgtcgacgccgggcttgccgagcgtgttgcgaaaggaatcggcgtgaacccgccgccgaaggaccgtgaatctgatgaaacgttcacttccccggccttaagccaggaaaacacggtgaagacggcagcgacaaggcaggttgcggttttaaccgaccacgggttttctgatgagaaagtcaaacaagtgcttgacgcatgcaaacaggcgggagtcagagccgatatcatcagtcctgtgcttggaaccgttaagggagaaaacggcacggagctcgaagcgtcagccacgttcctgacagcggattccgtcctgtacgacgctgttttcattccgggcggaaaacaaagcacagacagcctcaaagcccaaaaatcggccagagacttcgtcaacgaagctttcagccattacaaagcgatcggcgcctccggtgaaggaaaagaacttctcgccctcgccgccggaaccgaaagcggccccggtcttgttccggacggaaaccatgaacaatttctgaaagccgtggctgagcatcggcattgggacagaaacgtataagaatgaaaaagcgcctttgatgagaggggcgcttttttcttgtgaaagaatattgggagaaaacgaaaattgcttccgtacaaatccgtatcttccgctgtcctggacattcagacaacagttttagagagtcagggcatgcgctatttaaagcaggcgggttgatgaaataatagtttcaccctctttggtttacttccgccctgtgtttgtgtatcttaggggtagattttctggaggagcgattgatagtgaagccgtttaccgaaaaacaacttgaagaatattaccggcgtgacgaaaacatgatgattttggtgtttgcccaatggtgcgtcaatcatgaccttgatccgatggccatttacagcaaagcttaccccggacagcctttaaacgaagagctgcgaaaaacggctgaagagcttgtcgtgccgaaggaggaatcagaaccgattcctgatcaaaccgtcatcggcgttttggagatgttcggcaactccgatttggcggaagccgtttatgaagccattgcgcaaagaccttcacggtaaaagaggcgtggattatccatgtctctttttttcatggagaaaatgtgaaagaaggcccagaaacaatttgctgatctgcgctgtctatagagtgtaatccgttttcaaaaagggaacggtaatgaaaaggaggagttgtgatgaaaaaggcattcaaaatgatggcggccgtgctcttaaccgtgctgacagccgcgccgttcggaggtttcgcgccttcagccgaggccgcgcaaactgcaaagcccgtcgtcaaaagccagacgtataagcatgtaaagcagctgacgtaccccgaggtcacaaatacgggaaacgcatcttttgaaaagaaaatcaatcaggacttcaaacgctatattgaaaactcgtaccaagaatatgtaaaaaacaaaaaagacggtgaaaaacaaggctacaaagcggaataccaggcagatttcaaggtgaagtataatcaaggcggcaagctcagcattcagacggaaaactacagttacacaggcggcgcacacgggctgacagccgttcagacctttaattacgacctggccgcaaaaaaacgggtcacactcaatgatgtgctcaatacaaaaacgaaagccaacaaaacgagagactatctttacggctacatcaagaaacatgacgatctgtttgaccaggacgtcaaaaaacaagagatcatcctgaataacgaaagacctttcttctttacgaaaaacggcattgccgttgtgttggacaatatgatctcggaccatacgcggcaggaatccgggacgttttcgtgcctgcatccgtctatcaataaaaaaaagcgatatcactctaaaacggagcggtatcgctttttttattttaccagacaaacaatccgacaatcgccgcgctcaataaggaaacggcaattccgctgacaagcagcttccagacgttttttccgatgatggctgacttttcaccatcaagcagagattgataagatccgtagatcataccgatggtgctgaagtttgcgaatgatgtcaggaatgtcgtagccacggcaatcgtgtgcggcggaagtgatttcagctgccctttcagatcggccattgccacaaattcattcgtcgcgagcttgatgcccatcagctgtgcgacatacatcgcgtcatgtacgcctaatccgagaaggaaggcaaacggactgaagatgtatgagaaaatcttttgaatggtcaaaccgtgcatgaacagtccgagtacgccgtttaacgcagccgttaacgccacatatccgattaccatcgctaaaataacaatgaccatgttcatgccgacaagcatactgttagaaatcgtgggagaagaagtctttttctccgcttttgaaggaacgtaaataatatcatcctctttagaaacgtccacgggattcagcatattggcgattaaaagcgcgtttaagcaattcagcgggatagctgtaaacacataagtggacggaaccatcgtcaagtacgatccgatgatcgaaccgctgatgctgctcatgctcatcagcccgaatgtcagaagccgattgttgctgacggcggcaagctgctggcggatgacggctaaagcttccgtatttcctaaaaacatcatctggatggagaaaaagctctccagcttcggcagacgggatattttagaaatcagccagccgattttatcaatgagccacggcagaataccgaaatacgacagcatatcaaagaaggtcacgacgaagataatcgcagcaatgcgctgaagaaaaatcaaccgtcggattggccatgatagacggaaaagcgaacgcaattccttgactggcgcaggaaatcagccatgtaaagaacgcgccgatcttcccgatgacaaagccgccgacttttgtccctaacataaaccaagtaatcagaaactcaaagacgaggagcatgacaatcggacgccatttaatcttcttcttgttgggagaacataagaaaacaacagccatgacaacaatgagaccgacaatgttcaataaaaagtacatgtgagcaactcctataagggtattatggaaataaaaaaagctcttattcgtcacaaattcctgaaagccagaaagtgtgataaataagagccaaaagaaaagaatagactgagagcatcatatgcttttcactcgttcaaatttatgcaaactttcttgtagtctagtcttttacggcactaggtagaaacaatcagaccatattactgatcatatacaagaataacgatattacatgagatagcagtattttatcgtttcaatttttgaaaatcaacctttttagatattttcaaaataataaatttatattataaataaagaaaataaaggatgttcacaagtaa
